US008858949B2

(12) United States Patent
Yokoseki et al.

(10) Patent No.: US 8,858,949 B2
(45) Date of Patent: Oct. 14, 2014

(54) ANTIBODIES THAT SPECIFICALLY BIND TO A BETA OLIGOMERS AND USE THEREOF

(75) Inventors: Tatsuki Yokoseki, Kanagawa (JP); Yasuhide Okamoto, Kanagawa (JP); Makoto Umeda, Kanagawa (JP); Naofumi Takamatsu, Kanagawa (JP); Toshiyuki Ito, Kanagawa (JP); Yukiho Imai, Kanagawa (JP); Shinobu Fujii, Kanagawa (JP)

(73) Assignee: Immunas Pharma, Inc., Kanagawa (JP)

( * ) Notice: Subject to any disclaimer, the term of this patent is extended or adjusted under 35 U.S.C. 154(b) by 15 days.

(21) Appl. No.: 13/389,229

(22) PCT Filed: Aug. 5, 2010

(86) PCT No.: PCT/JP2010/004925
§ 371 (c)(1),
(2), (4) Date: Feb. 6, 2012

(87) PCT Pub. No.: WO2011/016238
PCT Pub. Date: Feb. 10, 2011

(65) Prior Publication Data
US 2012/0177664 A1    Jul. 12, 2012

Related U.S. Application Data

(60) Provisional application No. 61/231,797, filed on Aug. 6, 2009, provisional application No. 61/282,533, filed on Feb. 26, 2010.

(51) Int. Cl.
*A61K 39/395* (2006.01)
*G01N 33/566* (2006.01)
*G01N 33/68* (2006.01)
*C07K 16/18* (2006.01)

(52) U.S. Cl.
CPC ........ *G01N 33/6896* (2013.01); *C07K 2317/33* (2013.01); *G01N 2800/2821* (2013.01); *C07K 16/18* (2013.01)
USPC .................. 424/172.1; 530/387.3; 530/389.1; 530/391.1; 435/7.92; 436/501

(58) Field of Classification Search
CPC ............... C07K 16/18; C07K 2317/33; G01N 2800/2821; G01N 2333/4709; G01N 2800/2814; G01N 33/6854
USPC ........................ 424/172.1; 435/7.92; 436/501; 530/387.3, 389.1, 391.1
See application file for complete search history.

(56) References Cited

U.S. PATENT DOCUMENTS

| | | | |
|---|---|---|---|
| 6,218,506 B1 | 4/2001 | Krafft et al. | |
| 6,706,487 B1 | 3/2004 | Abdel-Meguid et al. | |
| 7,339,035 B2 | 3/2008 | Yanagisawa et al. | |
| 7,638,283 B2 | 12/2009 | Krafft et al. | |
| 7,741,448 B2 | 6/2010 | Yanagisawa et al. | |
| 8,378,081 B2 | 2/2013 | Matsubara et al. | |
| 2003/0068316 A1 | 4/2003 | Klein et al. | |
| 2006/0228349 A1 | 10/2006 | Acton et al. | |
| 2006/0257396 A1 | 11/2006 | Jacobsen | |
| 2007/0081998 A1 | 4/2007 | Kinney et al. | |
| 2007/0098721 A1 | 5/2007 | Hillen et al. | |
| 2007/0218499 A1 | 9/2007 | Lambert et al. | |
| 2010/0028357 A1 | 2/2010 | Matsubara et al. | |
| 2010/0183611 A1 | 7/2010 | Imboden et al. | |
| 2010/0260783 A1 | 10/2010 | Matsubara et al. | |
| 2010/0291071 A1 | 11/2010 | Matsubara et al. | |
| 2011/0097319 A1 | 4/2011 | Matsubara et al. | |
| 2012/0082667 A1 | 4/2012 | Yokoseki et al. | |
| 2012/0141477 A1 | 6/2012 | Matsubara et al. | |
| 2012/0156193 A1 | 6/2012 | Yokoseki et al. | |

FOREIGN PATENT DOCUMENTS

| | | |
|---|---|---|
| JP | 3512815 B2 | 1/2004 |
| JP | 2008-527005 A | 7/2008 |
| WO | WO 00/56771 A1 | 9/2000 |
| WO | WO 03/004056 A1 | 1/2003 |
| WO | WO 03/014162 A1 | 2/2003 |
| WO | WO 03/077858 A2 | 9/2003 |
| WO | WO 03/104437 A2 | 12/2003 |
| WO | WO 2006/047254 A1 | 5/2006 |
| WO | WO 2006/055178 A2 | 5/2006 |
| WO | WO 2006/083533 A2 | 8/2006 |
| WO | WO 2006/094724 A2 | 9/2006 |
| WO | WO 2006/137354 A1 | 12/2006 |
| WO | WO 2007/010040 A1 | 1/2007 |
| WO | WO 2007/108756 A1 | 9/2007 |
| WO | WO 2008/150946 A1 | 12/2008 |
| WO | WO 2009/051220 A1 | 4/2009 |
| WO | WO 2009/085200 A2 | 7/2009 |
| WO | WO 2009/099176 A1 | 8/2009 |
| WO | WO 2010/012004 A2 | 1/2010 |

OTHER PUBLICATIONS

Haass, C., et al., "Soluble protein oligomers in neurodegeneration: lessons from the Alzheimer's amyloid β-peptide," *Nat. Rev. Mol. Cell Bio.* 8:101-112, Nature Publishing Group, England (2007).

Kayed, R., et al., "Common Structure of Soluble Amyloid Oligomers Implies Common Mechanism of Pathogenesis," *Science* 300:486-489, American Association for the Advancement of Science, United States (2003).

(Continued)

*Primary Examiner* — Gregory S Emch

(74) *Attorney, Agent, or Firm* — Sterne, Kessler, Goldstein & Fox P.L.L.C.

(57) ABSTRACT

The present inventors successfully produced monoclonal antibodies that are specific to only soluble A beta oligomers, but do not recognize soluble A beta monomers, which are physiological molecules. It was demonstrated that the antibodies are useful as diagnostic/therapeutic monoclonal antibodies for Alzheimer's disease.

13 Claims, 37 Drawing Sheets

(56) References Cited

OTHER PUBLICATIONS

Kayed, R., et al., "Fibril specific, conformation dependent antibodies recognize a generic epitope common to amyloid fibrils and fibrillar oligomers that is absent in prefibrillar oligomers," *Mol. Neurodegener.* 2:18, BioMed Central Ltd., England (2007).
Klein, W. L., et al., "Targeting small Aβ oligomers: the solution to an Alzheimer's disease conundrum?" *Trends Neurosci.* 24(4):219-224, Elsevier Inc., England (2001).
Lambert, M. P., et al., "Vaccination with soluble Aβ oligomers generates toxicity-neutralizing antibodies," *J. Neurochem.* 79:595-605, International Society for Neurochemisty, England (2001).
Lambert, M. P., et al., "Monoclonal antibodies that target pathological assemblies of Aβ," *J. Neurochem.* 100:23-35, International Society for Neurochemistry, England (2007).
Lee, E. B., et al., "Targeting Amyloid-β Peptide (Aβ) Oligomers by Passive Immunization with a Conformation-selective Monoclonal Antibody Improves Learning and Memory in Aβ Precursor Protein (APP) Transgenic Mice," *J. Biol. Chem.* 281:4292-4299, American Society for Biochemistry and Molecular Biology, United States (2006).
Lesné, S., et al., "A specific amyloid-β protein assembly in the brain impairs memory," *Nature* 440:352-357, Nature Publishing Group, England (2006).
Matsubara, E., et al., "Development of a diagnosing system for Alzheimer' disease using anti-Aβ oligomer antibodies," Abstract 1-2-9, The 46th Annual of Japanese Society of Neurology, Kagoshima, Japan, May 25-27, 2005.
Matsubara, Etsuro, "Aβ oligomers," *Dementia Japan* 21:253-259, Japan (2007).
Matsubara, Etsuro, "Immunotherapy targeting Aβ oligomers for Alzheimer's disease," Abstract S31-2 and presentation, 8th Asia/Oceania Regional Congress of Gerontology and Geriatrics, Beijing, China, Oct. 22, 2007.
Matsubara, Etsuro, "Passive immunotherapy Aβ oligomer in Alzheimer's disease," Abstract S38-4, 128th Annual Meeting of the Pharmaceutical Society of Japan, Yokohama, Japan, Mar. 26-28, 2008.
Matsubara, Etsuro, "The Aβ-oligomer specific passive immunization in alzheimer's disease," 128th Annual Meeting of the Pharmaceutical Society of Japan, Yokohama, Japan, Feb. 1, 2007.
Matsubara, Etsuro, "Neurotoxic Aβ oligomer being the basis of developmental pathology of Alzheimer's disease," Abstract SY-2-2, The 49th Annual Meeting of Japanese Society of Neurology, Yokohama, Japan, Apr. 25, 2008.
Matsubara, Etsuro, "The Aβ-oligomer specific passive immunization in Alzheimer's disease," The 49th Annual Meeting of Japanese Society of Neurology, Yokohama, Japan, May 16, 2008.
Moretto, N., et al., "Conformation-sensitive Antibodies against Alzheimer Amyloid-β by Immunization with a Thioredoxin-constrained B-cell Epitope Peptide," *J. Biol. Chem.* 282-:11436-11445, American Society for Biochemistry and Molecular Biology, United States (2007).
Selkoe, Dennis J., "Alzheimer's Disease is a Synaptic Failure," *Science* 298:789-791, American Association for the Advancement of Science, United States (2002).
Shoji, M., et al., "Investigation on pathogenicity of Aβ peptide and development of pathogenic Aβ oligomer removal therapy," Health and Labour Sciences ResearchA Grants (Research on specified diseases), pp. 68-72 (2004).
Shoji, M., et al., "Antibody therapy for Alzheimer's disease," Health and Labour Sciences Research Grants, Study and research group on amyloidosis, pp. 76-78 (2008).
Sun, H., et al., "Characterization of therapeutic antibody against Aβ oligomers for Alzheimers disease," *Dementia Japan* 21:183, Abstract P2-261, Japan (2007).
Sun, H., et al., "Characterization of therapeutic antibody against Aβ oligomers for Alzheimer's disease," The 26th Annual Meeting of Japann Society for Dementia Research, Oct. 17-18, 2007.
Sun, H., et al., "Characterization of therapeutic antibody against Aβ oligomers for Alzheimer's disease," Abstract, Neuroscience 2007, San Diego, United States, Aug. 16, 2007.
Sun, H., et al., "Characterization of therapeutic antibody against Aβ oligomers for Alzheimer's disease," Poster 485.15/W10, Neuroscience 2007, San Diego, United States, Nov. 5, 2007.
Unverified English language translation of Matsubara, E., et al., "Development of a diagnosing system for Alzheimer' disease using anti-Aβ oligomer antibodies," Abstract 1-2-9, The 46th Annual Meeting of Japanese Society of Neurology, Kagoshima, Japan, May 25-27, 2005.
Unverified English language translation of Abstract of Matsubara, Etsuro, "Aβ oligomers," *Dementia Japan* 21:253-259, Japan (2007).
Unverified English language translation of Matsubara, Etsuro, "Passive immunotherapy Aβ oligomer in Alzheimer's disease," Abstract S38-4, 128th Annual Meeting of the Pharmaceutical Society of Japan, Yokohama, Japan, Mar. 26-28, 2008.
Unverified English language translation of Matsubara, Etsuro, "The Aβ-oligomer specific passive immunization in Alzheimer's disease," 128th Annual Meeting of the Pharmaceutical Society of Japan, Yokohama, Japan, Mar. 28, 2008.
Unverified English language translation of Matsubara, Etsuro, "Neurotoxic Aβ oligomer being the basis of developmental pathology of Alzheimer's disease," Abstract SY-2-2, The 49th Annual Meeting of Japanese Society of Neurology, Yokohama, Japan, May 15-17, 2008.
Unverified English language translation of Matsubara, Etsuro, "The Aβ-oligomer specific passive immunization in Alzheimer's disease," The 49th Annual Meeting of Japanese Society of Neurology, Yokohama, Japan, May 16, 2008.
Unverified English language translation of Shoji, M., et al., "Investigation on pathogenicity of Aβ peptide and development of pathogenic Aβ oligomer removal therapy," Health and Labour Sciences ResearchA Grants (Research on specified diseases), pp. 68-72 (2004).
Unverified English language translation of Shoji, M. et al., "Antibody therapy for Alzheimer's disease," Health and Labour Sciences Research Grants, Study and research group on amyloidosis, pp. 76-78 (2008).
Office Action mailed Apr. 13, 2011, in U.S. Appl. No. 12/533,294, inventors Matsubara, E., et al., filed Jul. 31, 2009, U.S. Patent and Trademark Office, Alexandria, VA.
Office Action mailed Jan. 19, 2012, in U.S. Appl. No. 12/762,878, inventors Matsubara, E., et al., filed Apr. 19, 2010, U.S. Patent and Trademark Office, Alexandria, VA.
Co-pending Application, U.S. Appl. No. 13/389,228, inventors Yokoseki, T., et al., Int'l Filing Date: Aug. 5, 2010 (Not Yet Published).
Brookmeyer, R. et al., "Forecasting the global burden of Alzheimer's disease," *Alzheimer's & Dementia* 3:186-191, The Alzheimer's Association (2007).
MA, Q.-L. et al., "Antibodies Against β-Amyloid Reduce Aβ Oligomers, Glycogen Synthase Kinase-3β Activation and τ Phosphorylation In Vivo and In Vitro," *J. Neurosci. Res.* 83:374-384, Wiley-Liss, Inc. (2006).
Wang, X.-p. et al., "Conformation-dependent single-chain variable fragment antibodies specifically recognize beta-amyloid oligomers," *FEBS Letts.* 583:579-584, Elsevier B.V. (2009).
Bussière, T. et al., "Animal Model: Morphological Characterization of Thioflavin-S-Positive Amyloid Plaques in Transgenic Alzheimer Mice and Effect of Passive Aβ Immunotherapy on Their Clearance," *Am J. Pathol.* 165:987-995, American Society for Investigative Pathology (2004).
Querfurth, H.W. and LaFerla, F.M., "Mechanisms of Disease: Alzheimer's Disease," *N. Engl. J. Med.* 362:329-344, Massachusetts Medical Society (2010).
Office Action mailed Aug. 29, 2012, in U.S. Appl. No. 12/762,878, inventors Matsubara, E. et al., filed Apr. 19, 2010, U.S. Patent and Trademark Office, Alexandria, VA.
Kayed, R. and Glabe, C.G., "Conformation-Dependent Anti-Amyloid Oligomer Antibodies," *Methods Enzymol.* 413:326-344, Elsevier Inc. (2006).

(56) References Cited

OTHER PUBLICATIONS

Klein, W.L., "Aβ toxicity in Alzheimer's disease: globular oligomers (ADDLs) as New vaccine and drug targets," *Neurochemistry International* 41:345-352, Elsevier Science Ltd. (2002).

Casset, F., et al., "A peptide mimetic of an anti-CD4 monoclonal antibody by rational design," *Biochem. Biophys. Res. Commun.* 307:198-205, Elsevier Science, United States (2003).

MacCallum, R.M., et al. "Antibody-antigen Interactions: Contact Analysis and Binding Site Topography," *J. Mol. Biol.* 262:732-745, Academic Press Limited, Netherlands (1996).

Padlan, E.A., et al., "Structure of an antibody-antigen complex: Crystal structure of the HyHEL-10 Fab—lysozyme complex," *Proc. Natl. Acad. Sci. USA* 86:5938-5942, National Academy of Science, United States (Aug. 1989).

Paul, W.E., ed., *Fundamental Immunology, Third Edition*, pp. 292-295, Raven Press, Ltd., New York, United States (1993).

Rudikoff, S., et al. "Single amino acid substitution altering antigen-binding specificity," *Proc. Natl. Acad. Sci. USA* 79:1979-1983, National Academy of Science, United States (Mar. 1982).

Terryberry, J.W., et al., "Autoantibodies in Neurodegenerative Diseases: Antigen-Specific Frequencies and Intrathecal Analysis," *Neurobiol. Aging* 19(3):205-216, Elsevier Science Inc., United States (1998).

Vajdos, F. F., et al. "Comprehensive Functional Maps of the Antigen-binding Site of an Anti-ErbB2 Antibody Obtained with Shotgun Scanning Mutagenesis," *J Mol. Biol.* 320:415-428, Elsevier Science Ltd., United States (2002).

International Search Report for International Application No. PCT/JP2010/004925, Japan Patent Office, Japan, mailed on Oct. 26, 2010.

Co-pending, U.S. Appl. No. 13/369,807, inventors Matsubara, E., et al., filed Feb. 9, 2012 (Not Yet Published).

Office Action mailed Apr. 12, 2011, in U.S. Appl. No. 12/533,348, inventors Matsubara, E., et al., filed Jul. 31, 2009, U.S. Patent and Trademark Office, Alexandria, VA.

Co-pending U.S. Appl. No. 13/760,936, inventors Matsubara, E., et al., filed Feb. 6, 2013 (Not Yet Published).

Office Action mailed Dec. 27, 2012, in U.S. Appl. No. 13/389,228, Yokoseki, T., et al., Int'l Filing Date of Aug. 5, 2010, U.S. Patent and Office, Alexandria, VA.

| | Aβ40 Aβ42<br>0  1   1 hr | | Aβ40 Aβ42<br>0  1   1 hr | | Aβ40 Aβ42<br>0  1   1 hr |
|---|---|---|---|---|---|
| IR-069 | | IR-089 | | IR-115 | |
| IR-070 | | IR-090 | | IR-116 | |
| IR-071 | | IR-092 | | IR-117 | |
| IR-072 | | IR-093 | | IR-118 | |
| IR-073 | | IR-094 | | IR-119 | |
| IR-074 | | IR-095 | | IR-120 | |
| IR-075 | | IR-097 | | IR-121 | |
| IR-076 | | IR-098 | | IR-122 | |
| IR-077 | | IR-100 | | IR-123 | |
| IR-078 | | IR-101 | | IR-124 | |
| IR-079 | | IR-102 | | IR-125 | |
| IR-080 | | IR-104 | | IR-126 | |
| IR-081 | | IR-105 | | IR-127 | |
| IR-082 | | IR-106 | | IR-128 | |
| IR-083 | | IR-107 | | IR-129 | |
| IR-084 | | IR-108 | | IR-131 | |
| IR-085 | | IR-109 | | IR-132 | |
| IR-086 | | IR-110 | | IR-133 | |
| IR-087 | | IR-112 | | IR-134 | |
| IR-088 | | IR-114 | | IR-135 | |

Fig. 1-3

| | Aβ40 Aβ42<br>0  1  1 hr | | Aβ40 Aβ42<br>0  1  1 hr | | Aβ40 Aβ42<br>0  1  1 hr |
|---|---|---|---|---|---|
| IR-136 | | IR-146 | | IR-157 | |
| IR-137 | | IR-147 | | IR-158 | |
| IR-138 | | IR-149 | | IR-159 | |
| IR-139 | | IR-150 | | IR-160 | |
| IR-140 | | IR-151 | | IR-161 | |
| IR-141 | | IR-152 | | | |
| IR-142 | | IR-153 | | | |
| IR-143 | | IR-154 | | | |
| IR-144 | | IR-155 | | | |
| IR-145 | | IR-156 | | | |

[Fig. 2-4]
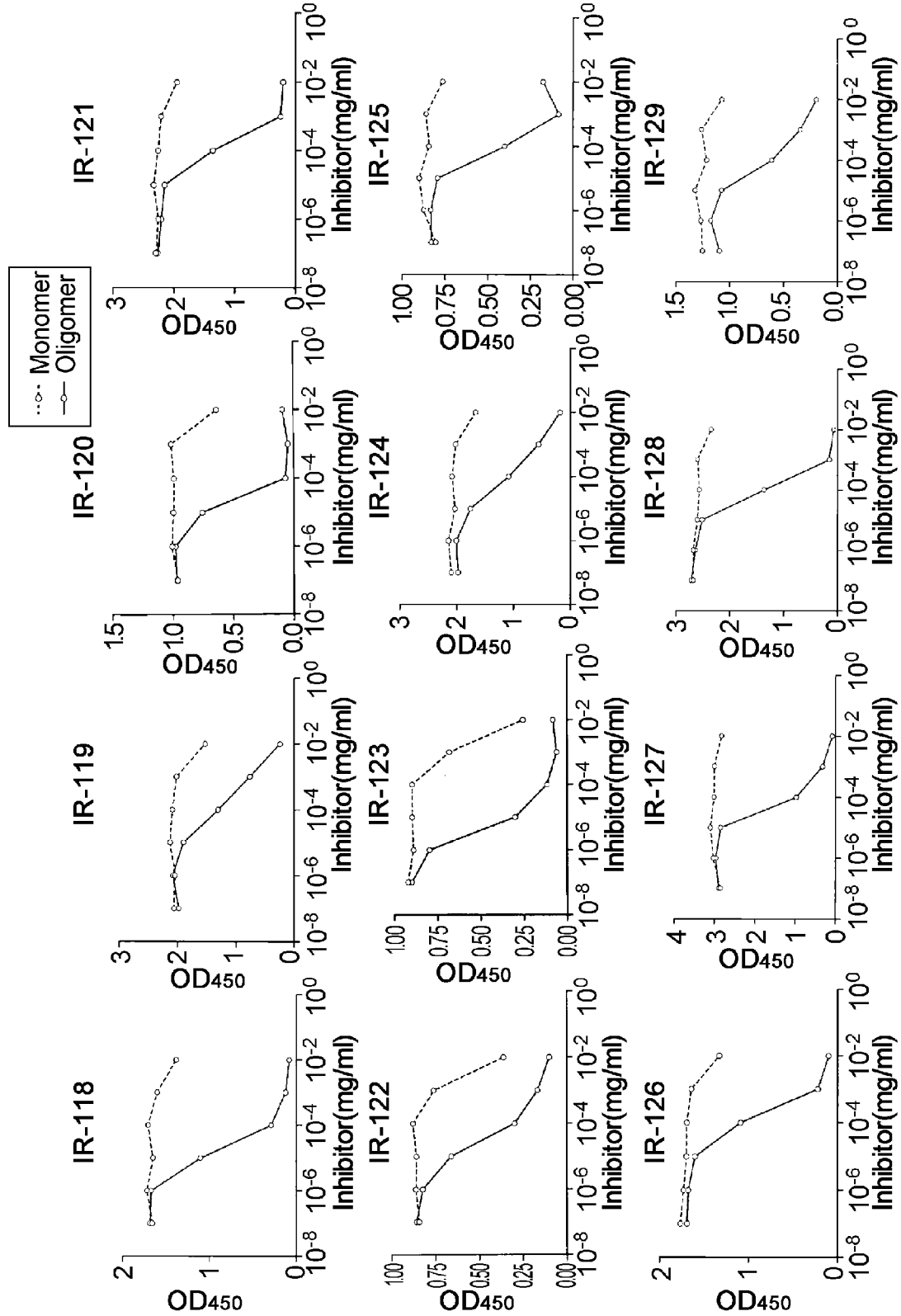

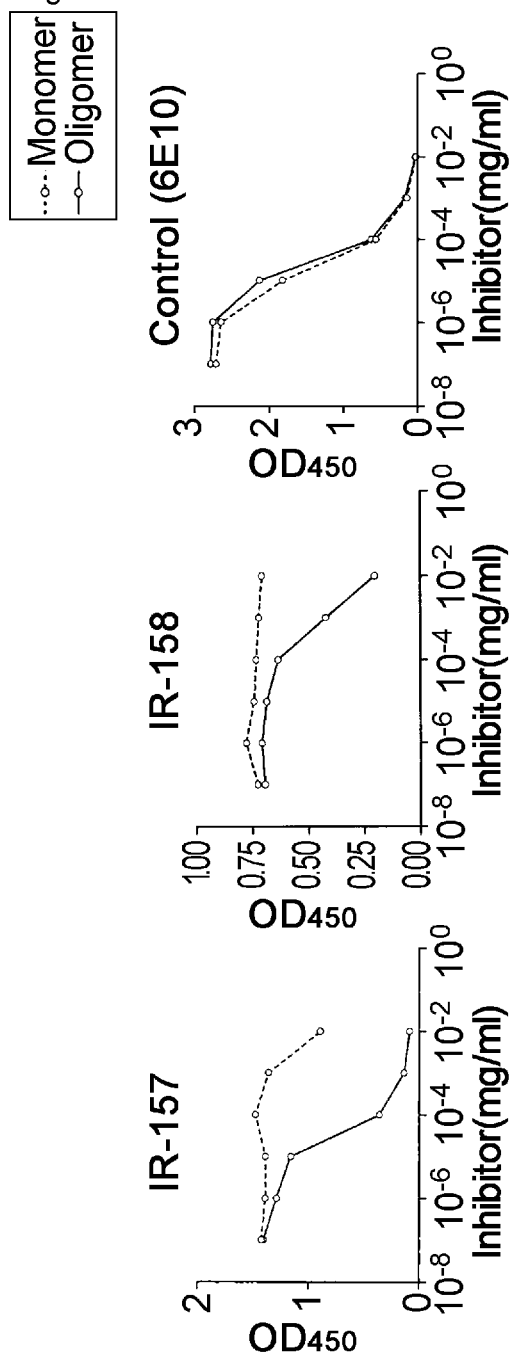

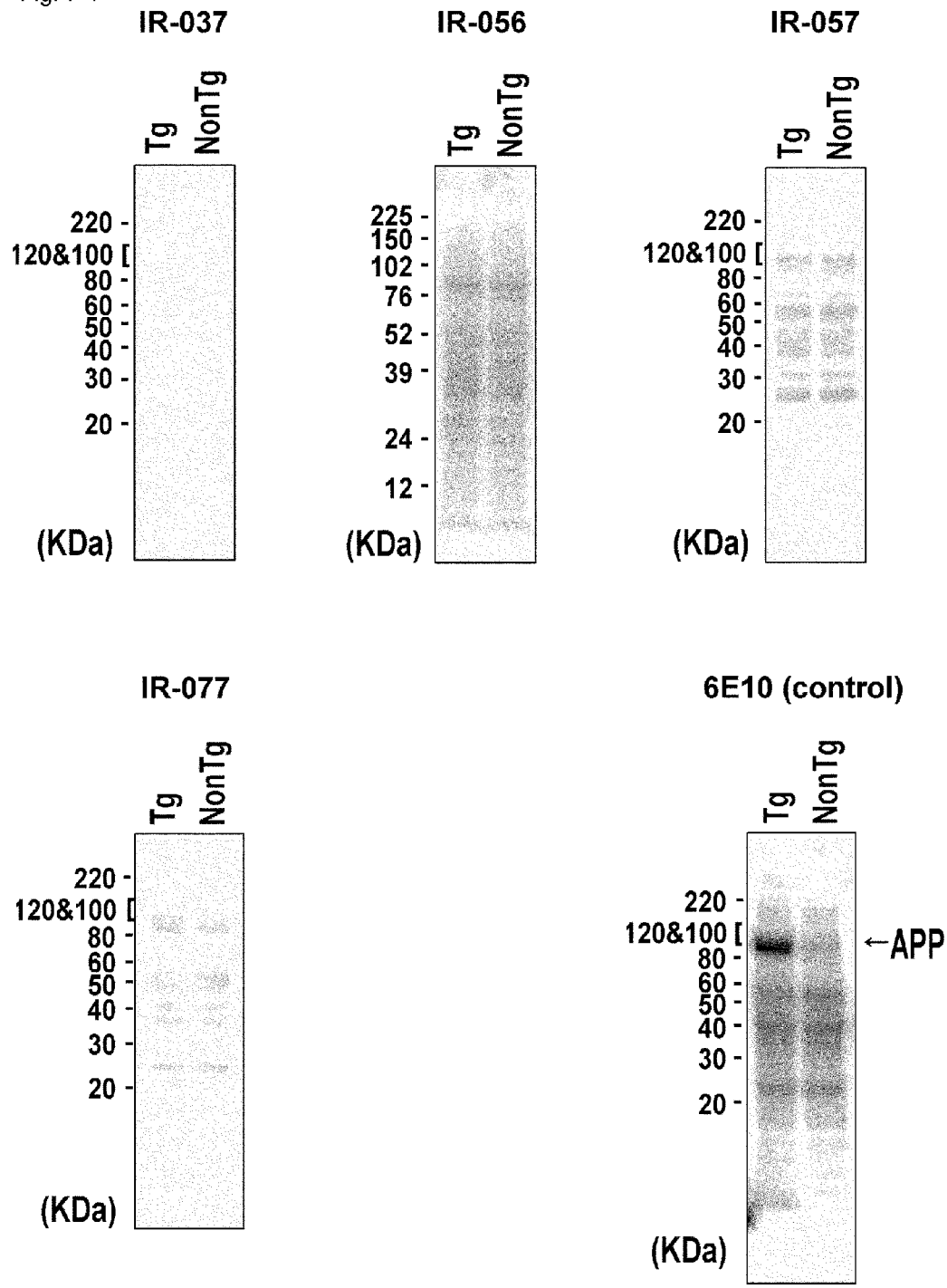

US 8,858,949 B2

ANTIBODIES THAT SPECIFICALLY BIND TO A BETA OLIGOMERS AND USE THEREOF

PRIORITY

The present application claims the benefit of U.S. Provisional Application No. 61/231,797, filed on Aug. 6, 2009, and U.S. Provisional Application No. 61/282,533, filed on Feb. 26, 2010, the entire contents of which are incorporated by reference herein.

REFERENCE TO SEQUENCE LISTING SUBMITTED ELECTRONICALLY

The content of the electronically submitted sequence listing, file name: 21440540002 sequencelstg.txt; Size: 1,245,657 bytes; Date of Creation: Feb. 28, 2012, filed herewith, is incorporated herein by reference in its entirety.

TECHNICAL FIELD

1. Technical Field

The present invention relates to antibodies that specifically bind to A beta oligomers and uses thereof.

2. Background Art

The number of Alzheimer's disease (AD) patients is more than about 26 million worldwide in 2006, and it is predicted to continue increasing in an aging society (Non-Patent Literature (NPL) 1). However, there is no curative therapeutic agent that arrests or reverses the progression of Alzheimer's disease, although therapeutic agents that retard the progression of the disease are commercially available.

Various evidence has shown that deterioration of memory arises from synaptic dysfunction triggered by soluble amyloid beta (A beta) oligomers (see Non-Patent Literatures 2 and 3). Excessive accumulation and deposition of A beta oligomers may be the trigger for a series of pathological cascades that lead to Alzheimer's disease. Therefore, therapeutic intervention targeting A beta oligomers may be effective for blocking these cascades (see Non-Patent Literatures 4 and 5).

Recently, antibody pharmaceuticals that target A beta are being developed. However, previously-reported anti-A beta oligomer antibodies do not specifically bind to A beta oligomers, but bind to all of the three forms, i.e., A beta monomers, oligomers, and fibrils. Thus, even if they are administered in vivo, it is thought that the amount of antibodies that bind to A beta oligomers would be relatively low, and the dosage may need to be increased to obtain effect. Moreover, since A beta monomers are present in the brain of healthy individuals, side effects may be cause by the binding of the antibodies to A beta monomers.

Furthermore, the amount of A beta oligomer could be an index of Alzheimer's disease; however, it was difficult to measure A beta oligomers alone using conventional anti-A beta antibodies.

Prior art information related to the present invention is shown below.

CITATION LIST

Non Patent Literature

NPL 1: Brookmeyer R et al., Alzheimers Dement. July; 3(3): 186-91, 2007
NPL 2: Klein W L, Trends Neurosci. 24: 219-224, 2001
NPL 3: Selkoe D J, Science 298: 789-791, 2002
NPL 4: Haass C et al.: Nat Rev Mol Cell Biol. 8: 101-12, 2007
NPL 5: Lee E B, et al.: J. Biol. Chem. 281: 4292-4299, 2006

SUMMARY OF INVENTION

Technical Problem

The present invention was achieved in view of the above circumstances. An objective of the present invention is to provide antibodies that bind specifically to A beta oligomers, and uses thereof. More specifically, the present invention provides antibodies that bind specifically to A beta oligomers, methods for detecting A beta oligomers using the antibodies, methods for diagnosing Alzheimer's disease using the antibodies, pharmaceutical compositions and agents comprising the antibodies, agents and kits for detecting A beta oligomers, and agents and kits for diagnosing Alzheimer's disease.

Solution to Problem

The present inventors successfully produced multiple monoclonal antibodies that are specific to only soluble amyloid beta (A beta) oligomers and do not recognize soluble A beta monomers which are physiological molecules, using an isolated A beta tetramer as an antigen.

Thus, the present inventors disclose that the multiple antibodies are promising candidates for therapeutic antibodies for treating/preventing Alzheimer's disease, or for diagnostic antibodies for diagnosing Alzheimer's disease.

More specifically, the present invention provides the following:

[1] An antibody that recognizes an isolated A beta oligomer as an antigen, wherein the antibody does not bind to an A beta monomer.

[2] The antibody of [1], which is any one of (1) to (290) below:

(1) an antibody that comprises an H chain having CDR1, CDR2, and CDR3, which are identified in VH comprising the amino acid sequence of SEQ ID NO: 2290;

(2) an antibody that comprises an L chain having CDR1, CDR2, and CDR3, which are identified in VL comprising the amino acid sequence of SEQ ID NO: 2292;

(3) an antibody that comprises an H chain having CDR1, CDR2, and CDR3, which are identified in VH comprising the amino acid sequence of SEQ ID NO: 2294;

(4) an antibody that comprises an L chain having CDR1, CDR2, and CDR3, which are identified in VL comprising the amino acid sequence of SEQ ID NO: 2296;

(5) an antibody that comprises an H chain having CDR1, CDR2, and CDR3, which are identified in VH comprising the amino acid sequence of SEQ ID NO: 2298;

(6) an antibody that comprises an L chain having CDR1, CDR2, and CDR3, which are identified in VL comprising the amino acid sequence of SEQ ID NO: 2300;

(7) an antibody that comprises an H chain having CDR1, CDR2, and CDR3, which are identified in VH comprising the amino acid sequence of SEQ ID NO: 2302;

(8) an antibody that comprises an L chain having CDR1, CDR2, and CDR3, which are identified in VL comprising the amino acid sequence of SEQ ID NO: 2304;

(9) an antibody that comprises an H chain having CDR1, CDR2, and CDR3, which are identified in VH comprising the amino acid sequence of SEQ ID NO: 2306;

(10) an antibody that comprises an L chain having CDR1, CDR2, and CDR3, which are identified in VL comprising the amino acid sequence of SEQ ID NO: 2308;

(11) an antibody that comprises an H chain having CDR1, CDR2, and CDR3, which are identified in VH comprising the amino acid sequence of SEQ ID NO: 2310;

(12) an antibody that comprises an L chain having CDR1, CDR2, and CDR3, which are identified in VL comprising the amino acid sequence of SEQ ID NO: 2312;

(13) an antibody that comprises an H chain having CDR1, CDR2, and CDR3, which are identified in VH comprising the amino acid sequence of SEQ ID NO: 2314;

(14) an antibody that comprises an L chain having CDR1, CDR2, and CDR3, which are identified in VL comprising the amino acid sequence of SEQ ID NO: 2316;

(15) an antibody that comprises an H chain having CDR1, CDR2, and CDR3, which are identified in VH comprising the amino acid sequence of SEQ ID NO: 2318;

(16) an antibody that comprises an L chain having CDR1, CDR2, and CDR3, which are identified in VL comprising the amino acid sequence of SEQ ID NO: 2320;

(17) an antibody that comprises an H chain having CDR1, CDR2, and CDR3, which are identified in VH comprising the amino acid sequence of SEQ ID NO: 2322;

(18) an antibody that comprises an L chain having CDR1, CDR2, and CDR3, which are identified in VL comprising the amino acid sequence of SEQ ID NO: 2324;

(19) an antibody that comprises an H chain having CDR1, CDR2, and CDR3, which are identified in VH comprising the amino acid sequence of SEQ ID NO: 2326;

(20) an antibody that comprises an L chain having CDR1, CDR2, and CDR3, which are identified in VL comprising the amino acid sequence of SEQ ID NO: 2328;

(21) an antibody that comprises an H chain having CDR1, CDR2, and CDR3, which are identified in VH comprising the amino acid sequence of SEQ ID NO: 2330;

(22) an antibody that comprises an L chain having CDR1, CDR2, and CDR3, which are identified in VL comprising the amino acid sequence of SEQ ID NO: 2332;

(23) an antibody that comprises an H chain having CDR1, CDR2, and CDR3, which are identified in VH comprising the amino acid sequence of SEQ ID NO: 2334;

(24) an antibody that comprises an L chain having CDR1, CDR2, and CDR3, which are identified in VL comprising the amino acid sequence of SEQ ID NO: 2336;

(25) an antibody that comprises an H chain having CDR1, CDR2, and CDR3, which are identified in VH comprising the amino acid sequence of SEQ ID NO: 2338;

(26) an antibody that comprises an L chain having CDR1, CDR2, and CDR3, which are identified in VL comprising the amino acid sequence of SEQ ID NO: 2340;

(27) an antibody that comprises an H chain having CDR1, CDR2, and CDR3, which are identified in VH comprising the amino acid sequence of SEQ ID NO: 2342;

(28) an antibody that comprises an L chain having CDR1, CDR2, and CDR3, which are identified in VL comprising the amino acid sequence of SEQ ID NO: 2344;

(29) an antibody that comprises an H chain having CDR1, CDR2, and CDR3, which are identified in VH comprising the amino acid sequence of SEQ ID NO: 2346;

(30) an antibody that comprises an L chain having CDR1, CDR2, and CDR3, which are identified in VL comprising the amino acid sequence of SEQ ID NO: 2348;

(31) an antibody that comprises an H chain having CDR1, CDR2, and CDR3, which are identified in VH comprising the amino acid sequence of SEQ ID NO: 2350;

(32) an antibody that comprises an L chain having CDR1, CDR2, and CDR3, which are identified in VL comprising the amino acid sequence of SEQ ID NO: 2352;

(33) an antibody that comprises an H chain having CDR1, CDR2, and CDR3, which are identified in VH comprising the amino acid sequence of SEQ ID NO: 2354;

(34) an antibody that comprises an L chain having CDR1, CDR2, and CDR3, which are identified in VL comprising the amino acid sequence of SEQ ID NO: 2356;

(35) an antibody that comprises an H chain having CDR1, CDR2, and CDR3, which are identified in VH comprising the amino acid sequence of SEQ ID NO: 2358;

(36) an antibody that comprises an L chain having CDR1, CDR2, and CDR3, which are identified in VL comprising the amino acid sequence of SEQ ID NO: 2360;

(37) an antibody that comprises an H chain having CDR1, CDR2, and CDR3, which are identified in VH comprising the amino acid sequence of SEQ ID NO: 2362;

(38) an antibody that comprises an L chain having CDR1, CDR2, and CDR3, which are identified in VL comprising the amino acid sequence of SEQ ID NO: 2364;

(39) an antibody that comprises an H chain having CDR1, CDR2, and CDR3, which are identified in VH comprising the amino acid sequence of SEQ ID NO: 2366;

(40) an antibody that comprises an L chain having CDR1, CDR2, and CDR3, which are identified in VL comprising the amino acid sequence of SEQ ID NO: 2368;

(41) an antibody that comprises an H chain having CDR1, CDR2, and CDR3, which are identified in VH comprising the amino acid sequence of SEQ ID NO: 2370;

(42) an antibody that comprises an L chain having CDR1, CDR2, and CDR3, which are identified in VL comprising the amino acid sequence of SEQ ID NO: 2372;

(43) an antibody that comprises an H chain having CDR1, CDR2, and CDR3, which are identified in VH comprising the amino acid sequence of SEQ ID NO: 2374;

(44) an antibody that comprises an L chain having CDR1, CDR2, and CDR3, which are identified in VL comprising the amino acid sequence of SEQ ID NO: 2376;

(45) an antibody that comprises an H chain having CDR1, CDR2, and CDR3, which are identified in VH comprising the amino acid sequence of SEQ ID NO: 2378;

(46) an antibody that comprises an L chain having CDR1, CDR2, and CDR3, which are identified in VL comprising the amino acid sequence of SEQ ID NO: 2380;

(47) an antibody that comprises an H chain having CDR1, CDR2, and CDR3, which are identified in VH comprising the amino acid sequence of SEQ ID NO: 2382;

(48) an antibody that comprises an L chain having CDR1, CDR2, and CDR3, which are identified in VL comprising the amino acid sequence of SEQ ID NO: 2384;

(49) an antibody that comprises an H chain having CDR1, CDR2, and CDR3, which are identified in VH comprising the amino acid sequence of SEQ ID NO: 2386;

(50) an antibody that comprises an L chain having CDR1, CDR2, and CDR3, which are identified in VL comprising the amino acid sequence of SEQ ID NO: 2388;

(51) an antibody that comprises an H chain having CDR1, CDR2, and CDR3, which are identified in VH comprising the amino acid sequence of SEQ ID NO: 2390;

(52) an antibody that comprises an L chain having CDR1, CDR2, and CDR3, which are identified in VL comprising the amino acid sequence of SEQ ID NO: 2392;

(53) an antibody that comprises an H chain having CDR1, CDR2, and CDR3, which are identified in VH comprising the amino acid sequence of SEQ ID NO: 2394;

(54) an antibody that comprises an L chain having CDR1, CDR2, and CDR3, which are identified in VL comprising the amino acid sequence of SEQ ID NO: 2396;

(55) an antibody that comprises an H chain having CDR1, CDR2, and CDR3, which are identified in VH comprising the amino acid sequence of SEQ ID NO: 2398;

(56) an antibody that comprises an L chain having CDR1, CDR2, and CDR3, which are identified in VL comprising the amino acid sequence of SEQ ID NO: 2400;

(57) an antibody that comprises an H chain having CDR1, CDR2, and CDR3, which are identified in VH comprising the amino acid sequence of SEQ ID NO: 2402;

(58) an antibody that comprises an L chain having CDR1, CDR2, and CDR3, which are identified in VL comprising the amino acid sequence of SEQ ID NO: 2404;

(59) an antibody that comprises an H chain having CDR1, CDR2, and CDR3, which are identified in VH comprising the amino acid sequence of SEQ ID NO: 2406;

(60) an antibody that comprises an L chain having CDR1, CDR2, and CDR3, which are identified in VL comprising the amino acid sequence of SEQ ID NO: 2408;

(61) an antibody that comprises an H chain having CDR1, CDR2, and CDR3, which are identified in VH comprising the amino acid sequence of SEQ ID NO: 2410;

(62) an antibody that comprises an L chain having CDR1, CDR2, and CDR3, which are identified in VL comprising the amino acid sequence of SEQ ID NO: 2412;

(63) an antibody that comprises an H chain having CDR1, CDR2, and CDR3, which are identified in VH comprising the amino acid sequence of SEQ ID NO: 2414;

(64) an antibody that comprises an L chain having CDR1, CDR2, and CDR3, which are identified in VL comprising the amino acid sequence of SEQ ID NO: 2416;

(65) an antibody that comprises an H chain having CDR1, CDR2, and CDR3, which are identified in VH comprising the amino acid sequence of SEQ ID NO: 2418;

(66) an antibody that comprises an L chain having CDR1, CDR2, and CDR3, which are identified in VL comprising the amino acid sequence of SEQ ID NO: 2420;

(67) an antibody that comprises an H chain having CDR1, CDR2, and CDR3, which are identified in VH comprising the amino acid sequence of SEQ ID NO: 2422;

(68) an antibody that comprises an L chain having CDR1, CDR2, and CDR3, which are identified in VL comprising the amino acid sequence of SEQ ID NO: 2424;

(69) an antibody that comprises an H chain having CDR1, CDR2, and CDR3, which are identified in VH comprising the amino acid sequence of SEQ ID NO: 2426;

(70) an antibody that comprises an L chain having CDR1, CDR2, and CDR3, which are identified in VL comprising the amino acid sequence of SEQ ID NO: 2428;

(71) an antibody that comprises an H chain having CDR1, CDR2, and CDR3, which are identified in VH comprising the amino acid sequence of SEQ ID NO: 2430;

(72) an antibody that comprises an L chain having CDR1, CDR2, and CDR3, which are identified in VL comprising the amino acid sequence of SEQ ID NO: 2432;

(73) an antibody that comprises an H chain having CDR1, CDR2, and CDR3, which are identified in VH comprising the amino acid sequence of SEQ ID NO: 2434;

(74) an antibody that comprises an L chain having CDR1, CDR2, and CDR3, which are identified in VL comprising the amino acid sequence of SEQ ID NO: 2436;

(75) an antibody that comprises an H chain having CDR1, CDR2, and CDR3, which are identified in VH comprising the amino acid sequence of SEQ ID NO: 2438;

(76) an antibody that comprises an L chain having CDR1, CDR2, and CDR3, which are identified in VL comprising the amino acid sequence of SEQ ID NO: 2440;

(77) an antibody that comprises an H chain having CDR1, CDR2, and CDR3, which are identified in VH comprising the amino acid sequence of SEQ ID NO: 2442;

(78) an antibody that comprises an L chain having CDR1, CDR2, and CDR3, which are identified in VL comprising the amino acid sequence of SEQ ID NO: 2444;

(79) an antibody that comprises an H chain having CDR1, CDR2, and CDR3, which are identified in VH comprising the amino acid sequence of SEQ ID NO: 2446;

(80) an antibody that comprises an L chain having CDR1, CDR2, and CDR3, which are identified in VL comprising the amino acid sequence of SEQ ID NO: 2448;

(81) an antibody that comprises an H chain having CDR1, CDR2, and CDR3, which are identified in VH comprising the amino acid sequence of SEQ ID NO: 2450;

(82) an antibody that comprises an L chain having CDR1, CDR2, and CDR3, which are identified in VL comprising the amino acid sequence of SEQ ID NO: 2452;

(83) an antibody that comprises an H chain having CDR1, CDR2, and CDR3, which are identified in VH comprising the amino acid sequence of SEQ ID NO: 2454;

(84) an antibody that comprises an L chain having CDR1, CDR2, and CDR3, which are identified in VL comprising the amino acid sequence of SEQ ID NO: 2456;

(85) an antibody that comprises an H chain having CDR1, CDR2, and CDR3, which are identified in VH comprising the amino acid sequence of SEQ ID NO: 2458;

(86) an antibody that comprises an L chain having CDR1, CDR2, and CDR3, which are identified in VL comprising the amino acid sequence of SEQ ID NO: 2460;

(87) an antibody that comprises an H chain having CDR1, CDR2, and CDR3, which are identified in VH comprising the amino acid sequence of SEQ ID NO: 2462;

(88) an antibody that comprises an L chain having CDR1, CDR2, and CDR3, which are identified in VL comprising the amino acid sequence of SEQ ID NO: 2464;

(89) an antibody that comprises an H chain having CDR1, CDR2, and CDR3, which are identified in VH comprising the amino acid sequence of SEQ ID NO: 2466;

(90) an antibody that comprises an L chain having CDR1, CDR2, and CDR3, which are identified in VL comprising the amino acid sequence of SEQ ID NO: 2468;

(91) an antibody that comprises an H chain having CDR1, CDR2, and CDR3, which are identified in VH comprising the amino acid sequence of SEQ ID NO: 2470;

(92) an antibody that comprises an L chain having CDR1, CDR2, and CDR3, which are identified in VL comprising the amino acid sequence of SEQ ID NO: 2472;

(93) an antibody that comprises an H chain having CDR1, CDR2, and CDR3, which are identified in VH comprising the amino acid sequence of SEQ ID NO: 2474;

(94) an antibody that comprises an L chain having CDR1, CDR2, and CDR3, which are identified in VL comprising the amino acid sequence of SEQ ID NO: 2476;

(95) an antibody that comprises an H chain having CDR1, CDR2, and CDR3, which are identified in VH comprising the amino acid sequence of SEQ ID NO: 2478;

(96) an antibody that comprises an L chain having CDR1, CDR2, and CDR3, which are identified in VL comprising the amino acid sequence of SEQ ID NO: 2480;

(97) an antibody that comprises an H chain having CDR1, CDR2, and CDR3, which are identified in VH comprising the amino acid sequence of SEQ ID NO: 2482;

(98) an antibody that comprises an L chain having CDR1, CDR2, and CDR3, which are identified in VL comprising the amino acid sequence of SEQ ID NO: 2484;

(99) an antibody that comprises an H chain having CDR1, CDR2, and CDR3, which are identified in VH comprising the amino acid sequence of SEQ ID NO: 2486;

(100) an antibody that comprises an L chain having CDR1, CDR2, and CDR3, which are identified in VL comprising the amino acid sequence of SEQ ID NO: 2488;

(101) an antibody that comprises an H chain having CDR1, CDR2, and CDR3, which are identified in VH comprising the amino acid sequence of SEQ ID NO: 2490;

(102) an antibody that comprises an L chain having CDR1, CDR2, and CDR3, which are identified in VL comprising the amino acid sequence of SEQ ID NO: 2492;

(103) an antibody that comprises an H chain having CDR1, CDR2, and CDR3, which are identified in VH comprising the amino acid sequence of SEQ ID NO: 2494;

(104) an antibody that comprises an L chain having CDR1, CDR2, and CDR3, which are identified in VL comprising the amino acid sequence of SEQ ID NO: 2496;

(105) an antibody that comprises an H chain having CDR1, CDR2, and CDR3, which are identified in VH comprising the amino acid sequence of SEQ ID NO: 2498;

(106) an antibody that comprises an L chain having CDR1, CDR2, and CDR3, which are identified in VL comprising the amino acid sequence of SEQ ID NO: 2500;

(107) an antibody that comprises an H chain having CDR1, CDR2, and CDR3, which are identified in VH comprising the amino acid sequence of SEQ ID NO: 2502;

(108) an antibody that comprises an L chain having CDR1, CDR2, and CDR3, which are identified in VL comprising the amino acid sequence of SEQ ID NO: 2504;

(109) an antibody that comprises an H chain having CDR1, CDR2, and CDR3, which are identified in VH comprising the amino acid sequence of SEQ ID NO: 2506;

(110) an antibody that comprises an L chain having CDR1, CDR2, and CDR3, which are identified in VL comprising the amino acid sequence of SEQ ID NO: 2508;

(111) an antibody that comprises an H chain having CDR1, CDR2, and CDR3, which are identified in VH comprising the amino acid sequence of SEQ ID NO: 2510;

(112) an antibody that comprises an L chain having CDR1, CDR2, and CDR3, which are identified in VL comprising the amino acid sequence of SEQ ID NO: 2512;

(113) an antibody that comprises an H chain having CDR1, CDR2, and CDR3, which are identified in VH comprising the amino acid sequence of SEQ ID NO: 2514;

(114) an antibody that comprises an L chain having CDR1, CDR2, and CDR3, which are identified in VL comprising the amino acid sequence of SEQ ID NO: 2516;

(115) an antibody that comprises an H chain having CDR1, CDR2, and CDR3, which are identified in VH comprising the amino acid sequence of SEQ ID NO: 2518;

(116) an antibody that comprises an L chain having CDR1, CDR2, and CDR3, which are identified in VL comprising the amino acid sequence of SEQ ID NO: 2520;

(117) an antibody that comprises an H chain having CDR1, CDR2, and CDR3, which are identified in VH comprising the amino acid sequence of SEQ ID NO: 2522;

(118) an antibody that comprises an L chain having CDR1, CDR2, and CDR3, which are identified in VL comprising the amino acid sequence of SEQ ID NO: 2524;

(119) an antibody that comprises an H chain having CDR1, CDR2, and CDR3, which are identified in VH comprising the amino acid sequence of SEQ ID NO: 2526;

(120) an antibody that comprises an L chain having CDR1, CDR2, and CDR3, which are identified in VL comprising the amino acid sequence of SEQ ID NO: 2528;

(121) an antibody that comprises an H chain having CDR1, CDR2, and CDR3, which are identified in VH comprising the amino acid sequence of SEQ ID NO: 2530;

(122) an antibody that comprises an L chain having CDR1, CDR2, and CDR3, which are identified in VL comprising the amino acid sequence of SEQ ID NO: 2532;

(123) an antibody that comprises an H chain having CDR1, CDR2, and CDR3, which are identified in VH comprising the amino acid sequence of SEQ ID NO: 2534;

(124) an antibody that comprises an L chain having CDR1, CDR2, and CDR3, which are identified in VL comprising the amino acid sequence of SEQ ID NO: 2536;

(125) an antibody that comprises an H chain having CDR1, CDR2, and CDR3, which are identified in VH comprising the amino acid sequence of SEQ ID NO: 2538;

(126) an antibody that comprises an L chain having CDR1, CDR2, and CDR3, which are identified in VL comprising the amino acid sequence of SEQ ID NO: 2540;

(127) an antibody that comprises an H chain having CDR1, CDR2, and CDR3, which are identified in VH comprising the amino acid sequence of SEQ ID NO: 2542;

(128) an antibody that comprises an L chain having CDR1, CDR2, and CDR3, which are identified in VL comprising the amino acid sequence of SEQ ID NO: 2544;

(129) an antibody that comprises an H chain having CDR1, CDR2, and CDR3, which are identified in VH comprising the amino acid sequence of SEQ ID NO: 2546;

(130) an antibody that comprises an L chain having CDR1, CDR2, and CDR3, which are identified in VL comprising the amino acid sequence of SEQ ID NO: 2548;

(131) an antibody that comprises an H chain having CDR1, CDR2, and CDR3, which are identified in VH comprising the amino acid sequence of SEQ ID NO: 2550;

(132) an antibody that comprises an L chain having CDR1, CDR2, and CDR3, which are identified in VL comprising the amino acid sequence of SEQ ID NO: 2552;

(133) an antibody that comprises an H chain having CDR1, CDR2, and CDR3, which are identified in VH comprising the amino acid sequence of SEQ ID NO: 2554;

(134) an antibody that comprises an L chain having CDR1, CDR2, and CDR3, which are identified in VL comprising the amino acid sequence of SEQ ID NO: 2556;

(135) an antibody that comprises an H chain having CDR1, CDR2, and CDR3, which are identified in VH comprising the amino acid sequence of SEQ ID NO: 2558;

(136) an antibody that comprises an L chain having CDR1, CDR2, and CDR3, which are identified in VL comprising the amino acid sequence of SEQ ID NO: 2560;

(137) an antibody that comprises an H chain having CDR1, CDR2, and CDR3, which are identified in VH comprising the amino acid sequence of SEQ ID NO: 2562;

(138) an antibody that comprises an L chain having CDR1, CDR2, and CDR3, which are identified in VL comprising the amino acid sequence of SEQ ID NO: 2564;

(139) an antibody that comprises an H chain having CDR1, CDR2, and CDR3, which are identified in VH comprising the amino acid sequence of SEQ ID NO: 2566;

(140) an antibody that comprises an L chain having CDR1, CDR2, and CDR3, which are identified in VL comprising the amino acid sequence of SEQ ID NO: 2568;

(141) an antibody that comprises an H chain having CDR1, CDR2, and CDR3, which are identified in VH comprising the amino acid sequence of SEQ ID NO: 2570;

(142) an antibody that comprises an L chain having CDR1, CDR2, and CDR3, which are identified in VL comprising the amino acid sequence of SEQ ID NO: 2572;

(143) an antibody that comprises an H chain having CDR1, CDR2, and CDR3, which are identified in VH comprising the amino acid sequence of SEQ ID NO: 2574;
(144) an antibody that comprises an L chain having CDR1, CDR2, and CDR3, which are identified in VL comprising the amino acid sequence of SEQ ID NO: 2576;
(145) an antibody that comprises an H chain having CDR1, CDR2, and CDR3, which are identified in VH comprising the amino acid sequence of SEQ ID NO: 2578;
(146) an antibody that comprises an L chain having CDR1, CDR2, and CDR3, which are identified in VL comprising the amino acid sequence of SEQ ID NO: 2580;
(147) an antibody that comprises an H chain having CDR1, CDR2, and CDR3, which are identified in VH comprising the amino acid sequence of SEQ ID NO: 2582;
(148) an antibody that comprises an L chain having CDR1, CDR2, and CDR3, which are identified in VL comprising the amino acid sequence of SEQ ID NO: 2584;
(149) an antibody that comprises an H chain having CDR1, CDR2, and CDR3, which are identified in VH comprising the amino acid sequence of SEQ ID NO: 2586;
(150) an antibody that comprises an L chain having CDR1, CDR2, and CDR3, which are identified in VL comprising the amino acid sequence of SEQ ID NO: 2588;
(151) an antibody that comprises an H chain having CDR1, CDR2, and CDR3, which are identified in VH comprising the amino acid sequence of SEQ ID NO: 2590;
(152) an antibody that comprises an L chain having CDR1, CDR2, and CDR3, which are identified in VL comprising the amino acid sequence of SEQ ID NO: 2592;
(153) an antibody that comprises an H chain having CDR1, CDR2, and CDR3, which are identified in VH comprising the amino acid sequence of SEQ ID NO: 2594;
(154) an antibody that comprises an L chain having CDR1, CDR2, and CDR3, which are identified in VL comprising the amino acid sequence of SEQ ID NO: 2596;
(155) an antibody that comprises an H chain having CDR1, CDR2, and CDR3, which are identified in VH comprising the amino acid sequence of SEQ ID NO: 2598;
(156) an antibody that comprises an L chain having CDR1, CDR2, and CDR3, which are identified in VL comprising the amino acid sequence of SEQ ID NO: 2600;
(157) an antibody that comprises an H chain having CDR1, CDR2, and CDR3, which are identified in VH comprising the amino acid sequence of SEQ ID NO: 2602;
(158) an antibody that comprises an L chain having CDR1, CDR2, and CDR3, which are identified in VL comprising the amino acid sequence of SEQ ID NO: 2604;
(159) an antibody that comprises an H chain having CDR1, CDR2, and CDR3, which are identified in VH comprising the amino acid sequence of SEQ ID NO: 2606;
(160) an antibody that comprises an L chain having CDR1, CDR2, and CDR3, which are identified in VL comprising the amino acid sequence of SEQ ID NO: 2608;
(161) an antibody that comprises an H chain having CDR1, CDR2, and CDR3, which are identified in VH comprising the amino acid sequence of SEQ ID NO: 2610;
(162) an antibody that comprises an L chain having CDR1, CDR2, and CDR3, which are identified in VL comprising the amino acid sequence of SEQ ID NO: 2612;
(163) an antibody that comprises an H chain having CDR1, CDR2, and CDR3, which are identified in VH comprising the amino acid sequence of SEQ ID NO: 2614;
(164) an antibody that comprises an L chain having CDR1, CDR2, and CDR3, which are identified in VL comprising the amino acid sequence of SEQ ID NO: 2616;
(165) an antibody that comprises an H chain having CDR1, CDR2, and CDR3, which are identified in VH comprising the amino acid sequence of SEQ ID NO: 2618;
(166) an antibody that comprises an L chain having CDR1, CDR2, and CDR3, which are identified in VL comprising the amino acid sequence of SEQ ID NO: 2620;
(167) an antibody that comprises an H chain having CDR1, CDR2, and CDR3, which are identified in VH comprising the amino acid sequence of SEQ ID NO: 2622;
(168) an antibody that comprises an L chain having CDR1, CDR2, and CDR3, which are identified in VL comprising the amino acid sequence of SEQ ID NO: 2624;
(169) an antibody that comprises an H chain having CDR1, CDR2, and CDR3, which are identified in VH comprising the amino acid sequence of SEQ ID NO: 2626;
(170) an antibody that comprises an L chain having CDR1, CDR2, and CDR3, which are identified in VL comprising the amino acid sequence of SEQ ID NO: 2628;
(171) an antibody that comprises an H chain having CDR1, CDR2, and CDR3, which are identified in VH comprising the amino acid sequence of SEQ ID NO: 2630;
(172) an antibody that comprises an L chain having CDR1, CDR2, and CDR3, which are identified in VL comprising the amino acid sequence of SEQ ID NO: 2632;
(173) an antibody that comprises an H chain having CDR1, CDR2, and CDR3, which are identified in VH comprising the amino acid sequence of SEQ ID NO: 2634;
(174) an antibody that comprises an L chain having CDR1, CDR2, and CDR3, which are identified in VL comprising the amino acid sequence of SEQ ID NO: 2636;
(175) an antibody that comprises an H chain having CDR1, CDR2, and CDR3, which are identified in VH comprising the amino acid sequence of SEQ ID NO: 2638;
(176) an antibody that comprises an L chain having CDR1, CDR2, and CDR3, which are identified in VL comprising the amino acid sequence of SEQ ID NO: 2640;
(177) an antibody that comprises an H chain having CDR1, CDR2, and CDR3, which are identified in VH comprising the amino acid sequence of SEQ ID NO: 2642;
(178) an antibody that comprises an L chain having CDR1, CDR2, and CDR3, which are identified in VL comprising the amino acid sequence of SEQ ID NO: 2644;
(179) an antibody that comprises an H chain having CDR1, CDR2, and CDR3, which are identified in VH comprising the amino acid sequence of SEQ ID NO: 2646;
(180) an antibody that comprises an L chain having CDR1, CDR2, and CDR3, which are identified in VL comprising the amino acid sequence of SEQ ID NO: 2648;
(181) an antibody that comprises an H chain having CDR1, CDR2, and CDR3, which are identified in VH comprising the amino acid sequence of SEQ ID NO: 2650;
(182) an antibody that comprises an L chain having CDR1, CDR2, and CDR3, which are identified in VL comprising the amino acid sequence of SEQ ID NO: 2652;
(183) an antibody that comprises an H chain having CDR1, CDR2, and CDR3, which are identified in VH comprising the amino acid sequence of SEQ ID NO: 2654;
(184) an antibody that comprises an L chain having CDR1, CDR2, and CDR3, which are identified in VL comprising the amino acid sequence of SEQ ID NO: 2656;
(185) an antibody that comprises an H chain having CDR1, CDR2, and CDR3, which are identified in VH comprising the amino acid sequence of SEQ ID NO: 2658;
(186) an antibody that comprises an L chain having CDR1, CDR2, and CDR3, which are identified in VL comprising the amino acid sequence of SEQ ID NO: 2660;

(187) an antibody that comprises an H chain having CDR1, CDR2, and CDR3, which are identified in VH comprising the amino acid sequence of SEQ ID NO: 2662;
(188) an antibody that comprises an L chain having CDR1, CDR2, and CDR3, which are identified in VL comprising the amino acid sequence of SEQ ID NO: 2664;
(189) an antibody that comprises an H chain having CDR1, CDR2, and CDR3, which are identified in VH comprising the amino acid sequence of SEQ ID NO: 2666;
(190) an antibody that comprises an L chain having CDR1, CDR2, and CDR3, which are identified in VL comprising the amino acid sequence of SEQ ID NO: 2668;
(191) an antibody that comprises an H chain having CDR1, CDR2, and CDR3, which are identified in VH comprising the amino acid sequence of SEQ ID NO: 2670;
(192) an antibody that comprises an L chain having CDR1, CDR2, and CDR3, which are identified in VL comprising the amino acid sequence of SEQ ID NO: 2672;
(193) an antibody that comprises an H chain having CDR1, CDR2, and CDR3, which are identified in VH comprising the amino acid sequence of SEQ ID NO: 2674;
(194) an antibody that comprises an L chain having CDR1, CDR2, and CDR3, which are identified in VL comprising the amino acid sequence of SEQ ID NO: 2676;
(195) an antibody that comprises an H chain having CDR1, CDR2, and CDR3, which are identified in VH comprising the amino acid sequence of SEQ ID NO: 2678;
(196) an antibody that comprises an L chain having CDR1, CDR2, and CDR3, which are identified in VL comprising the amino acid sequence of SEQ ID NO: 2680;
(197) an antibody that comprises an H chain having CDR1, CDR2, and CDR3, which are identified in VH comprising the amino acid sequence of SEQ ID NO: 2682;
(198) an antibody that comprises an L chain having CDR1, CDR2, and CDR3, which are identified in VL comprising the amino acid sequence of SEQ ID NO: 2684;
(199) an antibody that comprises an H chain having CDR1, CDR2, and CDR3, which are identified in VH comprising the amino acid sequence of SEQ ID NO: 2686;
(200) an antibody that comprises an L chain having CDR1, CDR2, and CDR3, which are identified in VL comprising the amino acid sequence of SEQ ID NO: 2688;
(201) an antibody that comprises an H chain having CDR1, CDR2, and CDR3, which are identified in VH comprising the amino acid sequence of SEQ ID NO: 2690;
(202) an antibody that comprises an L chain having CDR1, CDR2, and CDR3, which are identified in VL comprising the amino acid sequence of SEQ ID NO: 2692;
(203) an antibody that comprises an H chain having CDR1, CDR2, and CDR3, which are identified in VH comprising the amino acid sequence of SEQ ID NO: 2694;
(204) an antibody that comprises an L chain having CDR1, CDR2, and CDR3, which are identified in VL comprising the amino acid sequence of SEQ ID NO: 2696;
(205) an antibody that comprises an H chain having CDR1, CDR2, and CDR3, which are identified in VH comprising the amino acid sequence of SEQ ID NO: 2698;
(206) an antibody that comprises an L chain having CDR1, CDR2, and CDR3, which are identified in VL comprising the amino acid sequence of SEQ ID NO: 2700;
(207) an antibody that comprises an H chain having CDR1, CDR2, and CDR3, which are identified in VH comprising the amino acid sequence of SEQ ID NO: 2702;
(208) an antibody that comprises an L chain having CDR1, CDR2, and CDR3, which are identified in VL comprising the amino acid sequence of SEQ ID NO: 2704;
(209) an antibody that comprises an H chain having CDR1, CDR2, and CDR3, which are identified in VH comprising the amino acid sequence of SEQ ID NO: 2706;
(210) an antibody that comprises an L chain having CDR1, CDR2, and CDR3, which are identified in VL comprising the amino acid sequence of SEQ ID NO: 2708;
(211) an antibody that comprises an H chain having CDR1, CDR2, and CDR3, which are identified in VH comprising the amino acid sequence of SEQ ID NO: 2710;
(212) an antibody that comprises an L chain having CDR1, CDR2, and CDR3, which are identified in VL comprising the amino acid sequence of SEQ ID NO: 2712;
(213) an antibody that comprises an H chain having CDR1, CDR2, and CDR3, which are identified in VH comprising the amino acid sequence of SEQ ID NO: 2714;
(214) an antibody that comprises an L chain having CDR1, CDR2, and CDR3, which are identified in VL comprising the amino acid sequence of SEQ ID NO: 2716;
(215) an antibody that comprises an H chain having CDR1, CDR2, and CDR3, which are identified in VH comprising the amino acid sequence of SEQ ID NO: 2718;
(216) an antibody that comprises an L chain having CDR1, CDR2, and CDR3, which are identified in VL comprising the amino acid sequence of SEQ ID NO: 2720;
(217) an antibody that comprises an H chain having CDR1, CDR2, and CDR3, which are identified in VH comprising the amino acid sequence of SEQ ID NO: 2722;
(218) an antibody that comprises an L chain having CDR1, CDR2, and CDR3, which are identified in VL comprising the amino acid sequence of SEQ ID NO: 2724;
(219) an antibody that comprises an H chain having CDR1, CDR2, and CDR3, which are identified in VH comprising the amino acid sequence of SEQ ID NO: 2726;
(220) an antibody that comprises an L chain having CDR1, CDR2, and CDR3, which are identified in VL comprising the amino acid sequence of SEQ ID NO: 2728;
(221) an antibody that comprises an H chain having CDR1, CDR2, and CDR3, which are identified in VH comprising the amino acid sequence of SEQ ID NO: 2730;
(222) an antibody that comprises an L chain having CDR1, CDR2, and CDR3, which are identified in VL comprising the amino acid sequence of SEQ ID NO: 2732;
(223) an antibody that comprises an H chain having CDR1, CDR2, and CDR3, which are identified in VH comprising the amino acid sequence of SEQ ID NO: 2734;
(224) an antibody that comprises an L chain having CDR1, CDR2, and CDR3, which are identified in VL comprising the amino acid sequence of SEQ ID NO: 2736;
(225) an antibody that comprises an H chain having CDR1, CDR2, and CDR3, which are identified in VH comprising the amino acid sequence of SEQ ID NO: 2738;
(226) an antibody that comprises an L chain having CDR1, CDR2, and CDR3, which are identified in VL comprising the amino acid sequence of SEQ ID NO: 2740;
(227) an antibody that comprises an H chain having CDR1, CDR2, and CDR3, which are identified in VH comprising the amino acid sequence of SEQ ID NO: 2742;
(228) an antibody that comprises an L chain having CDR1, CDR2, and CDR3, which are identified in VL comprising the amino acid sequence of SEQ ID NO: 2744;
(229) an antibody that comprises an H chain having CDR1, CDR2, and CDR3, which are identified in VH comprising the amino acid sequence of SEQ ID NO: 2746;
(230) an antibody that comprises an L chain having CDR1, CDR2, and CDR3, which are identified in VL comprising the amino acid sequence of SEQ ID NO: 2748;

(231) an antibody that comprises an H chain having CDR1, CDR2, and CDR3, which are identified in VH comprising the amino acid sequence of SEQ ID NO: 2750;
(232) an antibody that comprises an L chain having CDR1, CDR2, and CDR3, which are identified in VL comprising the amino acid sequence of SEQ ID NO: 2752;
(233) an antibody that comprises an H chain having CDR1, CDR2, and CDR3, which are identified in VH comprising the amino acid sequence of SEQ ID NO: 2754;
(234) an antibody that comprises an L chain having CDR1, CDR2, and CDR3, which are identified in VL comprising the amino acid sequence of SEQ ID NO: 2756;
(235) an antibody that comprises an H chain having CDR1, CDR2, and CDR3, which are identified in VH comprising the amino acid sequence of SEQ ID NO: 2758;
(236) an antibody that comprises an L chain having CDR1, CDR2, and CDR3, which are identified in VL comprising the amino acid sequence of SEQ ID NO: 2760;
(237) an antibody that comprises an H chain having CDR1, CDR2, and CDR3, which are identified in VH comprising the amino acid sequence of SEQ ID NO: 2762;
(238) an antibody that comprises an L chain having CDR1, CDR2, and CDR3, which are identified in VL comprising the amino acid sequence of SEQ ID NO: 2764;
(239) an antibody that comprises an H chain having CDR1, CDR2, and CDR3, which are identified in VH comprising the amino acid sequence of SEQ ID NO: 2766;
(240) an antibody that comprises an L chain having CDR1, CDR2, and CDR3, which are identified in VL comprising the amino acid sequence of SEQ ID NO: 2768;
(241) an antibody that comprises an H chain having CDR1, CDR2, and CDR3, which are identified in VH comprising the amino acid sequence of SEQ ID NO: 2770;
(242) an antibody that comprises an L chain having CDR1, CDR2, and CDR3, which are identified in VL comprising the amino acid sequence of SEQ ID NO: 2772;
(243) an antibody that comprises an H chain having CDR1, CDR2, and CDR3, which are identified in VH comprising the amino acid sequence of SEQ ID NO: 2774;
(244) an antibody that comprises an L chain having CDR1, CDR2, and CDR3, which are identified in VL comprising the amino acid sequence of SEQ ID NO: 2776;
(245) an antibody that comprises an H chain having CDR1, CDR2, and CDR3, which are identified in VH comprising the amino acid sequence of SEQ ID NO: 2778;
(246) an antibody that comprises an L chain having CDR1, CDR2, and CDR3, which are identified in VL comprising the amino acid sequence of SEQ ID NO: 2780;
(247) an antibody that comprises an H chain having CDR1, CDR2, and CDR3, which are identified in VH comprising the amino acid sequence of SEQ ID NO: 2782;
(248) an antibody that comprises an L chain having CDR1, CDR2, and CDR3, which are identified in VL comprising the amino acid sequence of SEQ ID NO: 2784;
(249) an antibody that comprises an H chain having CDR1, CDR2, and CDR3, which are identified in VH comprising the amino acid sequence of SEQ ID NO: 2786;
(250) an antibody that comprises an L chain having CDR1, CDR2, and CDR3, which are identified in VL comprising the amino acid sequence of SEQ ID NO: 2788;
(251) an antibody that comprises an H chain having CDR1, CDR2, and CDR3, which are identified in VH comprising the amino acid sequence of SEQ ID NO: 2790;
(252) an antibody that comprises an L chain having CDR1, CDR2, and CDR3, which are identified in VL comprising the amino acid sequence of SEQ ID NO: 2792;
(253) an antibody that comprises an H chain having CDR1, CDR2, and CDR3, which are identified in VH comprising the amino acid sequence of SEQ ID NO: 2794;
(254) an antibody that comprises an L chain having CDR1, CDR2, and CDR3, which are identified in VL comprising the amino acid sequence of SEQ ID NO: 2796;
(255) an antibody that comprises an H chain having CDR1, CDR2, and CDR3, which are identified in VH comprising the amino acid sequence of SEQ ID NO: 2798;
(256) an antibody that comprises an L chain having CDR1, CDR2, and CDR3, which are identified in VL comprising the amino acid sequence of SEQ ID NO: 2800;
(257) an antibody that comprises an H chain having CDR1, CDR2, and CDR3, which are identified in VH comprising the amino acid sequence of SEQ ID NO: 2802;
(258) an antibody that comprises an L chain having CDR1, CDR2, and CDR3, which are identified in VL comprising the amino acid sequence of SEQ ID NO: 2804;
(259) an antibody that comprises an H chain having CDR1, CDR2, and CDR3, which are identified in VH comprising the amino acid sequence of SEQ ID NO: 2806;
(260) an antibody that comprises an L chain having CDR1, CDR2, and CDR3, which are identified in VL comprising the amino acid sequence of SEQ ID NO: 2808;
(261) an antibody that comprises an H chain having CDR1, CDR2, and CDR3, which are identified in VH comprising the amino acid sequence of SEQ ID NO: 2810;
(262) an antibody that comprises an L chain having CDR1, CDR2, and CDR3, which are identified in VL comprising the amino acid sequence of SEQ ID NO: 2812;
(263) an antibody that comprises an H chain having CDR1, CDR2, and CDR3, which are identified in VH comprising the amino acid sequence of SEQ ID NO: 2814;
(264) an antibody that comprises an L chain having CDR1, CDR2, and CDR3, which are identified in VL comprising the amino acid sequence of SEQ ID NO: 2816;
(265) an antibody that comprises an H chain having CDR1, CDR2, and CDR3, which are identified in VH comprising the amino acid sequence of SEQ ID NO: 2818;
(266) an antibody that comprises an L chain having CDR1, CDR2, and CDR3, which are identified in VL comprising the amino acid sequence of SEQ ID NO: 2820;
(267) an antibody that comprises an H chain having CDR1, CDR2, and CDR3, which are identified in VH comprising the amino acid sequence of SEQ ID NO: 2822;
(268) an antibody that comprises an L chain having CDR1, CDR2, and CDR3, which are identified in VL comprising the amino acid sequence of SEQ ID NO: 2824;
(269) an antibody that comprises an H chain having CDR1, CDR2, and CDR3, which are identified in VH comprising the amino acid sequence of SEQ ID NO: 2826;
(270) an antibody that comprises an L chain having CDR1, CDR2, and CDR3, which are identified in VL comprising the amino acid sequence of SEQ ID NO: 2828;
(271) an antibody that comprises an H chain having CDR1, CDR2, and CDR3, which are identified in VH comprising the amino acid sequence of SEQ ID NO: 2830;
(272) an antibody that comprises an L chain having CDR1, CDR2, and CDR3, which are identified in VL comprising the amino acid sequence of SEQ ID NO: 2832;
(273) an antibody that comprises an H chain having CDR1, CDR2, and CDR3, which are identified in VH comprising the amino acid sequence of SEQ ID NO: 2834;
(274) an antibody that comprises an L chain having CDR1, CDR2, and CDR3, which are identified in VL comprising the amino acid sequence of SEQ ID NO: 2836;

(275) an antibody that comprises an H chain having CDR1, CDR2, and CDR3, which are identified in VH comprising the amino acid sequence of SEQ ID NO: 2838;

(276) an antibody that comprises an L chain having CDR1, CDR2, and CDR3, which are identified in VL comprising the amino acid sequence of SEQ ID NO: 2840;

(277) an antibody that comprises an H chain having CDR1, CDR2, and CDR3, which are identified in VH comprising the amino acid sequence of SEQ ID NO: 2842;

(278) an antibody that comprises an L chain having CDR1, CDR2, and CDR3, which are identified in VL comprising the amino acid sequence of SEQ ID NO: 2844;

(279) an antibody that comprises an H chain having CDR1, CDR2, and CDR3, which are identified in VH comprising the amino acid sequence of SEQ ID NO: 2846;

(280) an antibody that comprises an L chain having CDR1, CDR2, and CDR3, which are identified in VL comprising the amino acid sequence of SEQ ID NO: 2848;

(281) an antibody that comprises an H chain having CDR1, CDR2, and CDR3, which are identified in VH comprising the amino acid sequence of SEQ ID NO: 2850;

(282) an antibody that comprises an L chain having CDR1, CDR2, and CDR3, which are identified in VL comprising the amino acid sequence of SEQ ID NO: 2852;

(283) an antibody that comprises an H chain having CDR1, CDR2, and CDR3, which are identified in VH comprising the amino acid sequence of SEQ ID NO: 2854;

(284) an antibody that comprises an L chain having CDR1, CDR2, and CDR3, which are identified in VL comprising the amino acid sequence of SEQ ID NO: 2856;

(285) an antibody that comprises an H chain having CDR1, CDR2, and CDR3, which are identified in VH comprising the amino acid sequence of SEQ ID NO: 2858;

(286) an antibody that comprises an L chain having CDR1, CDR2, and CDR3, which are identified in VL comprising the amino acid sequence of SEQ ID NO: 2860;

(287) an antibody that comprises an H chain having CDR1, CDR2, and CDR3, which are identified in VH comprising the amino acid sequence of SEQ ID NO: 2862;

(288) an antibody that comprises an L chain having CDR1, CDR2, and CDR3, which are identified in VL comprising the amino acid sequence of SEQ ID NO: 2864;

(289) an antibody that comprises an H chain having CDR1, CDR2, and CDR3, which are identified in VH comprising the amino acid sequence of SEQ ID NO: 2878;

(290) an antibody that comprises an L chain having CDR1, CDR2, and CDR3, which are identified in VL comprising the amino acid sequence of SEQ ID NO: 2880.

[3] The antibody of [1], which is any one of (1) to (872) below:

(1) an antibody that comprises an H chain having the amino acid sequence of SEQ ID NO: 6 as CDR1, the amino acid sequence of SEQ ID NO: 8 as CDR2, and the amino acid sequence of SEQ ID NO: 10 as CDR3;

(2) an antibody that comprises an L chain having the amino acid sequence of SEQ ID NO: 12 as CDR1, the amino acid sequence of SEQ ID NO: 14 as CDR2, and the amino acid sequence of SEQ ID NO: 16 as CDR3;

(3) an antibody that comprises the H chain of (1) and the L chain of (2);

(4) an antibody that comprises an H chain having the amino acid sequence of SEQ ID NO: 2290 as VH;

(5) an antibody that comprises an L chain having the amino acid sequence of SEQ ID NO: 2292 as VL;

(6) an antibody that comprises the H chain of (4) and the L chain of (5);

(7) an antibody that comprises an H chain having the amino acid sequence of SEQ ID NO: 22 as CDR1, the amino acid sequence of SEQ ID NO: 24 as CDR2, and the amino acid sequence of SEQ ID NO: 26 as CDR3;

(8) an antibody that comprises an L chain having the amino acid sequence of SEQ ID NO: 28 as CDR1, the amino acid sequence of SEQ ID NO: 30 as CDR2, and the amino acid sequence of SEQ ID NO: 32 as CDR3;

(9) an antibody that comprises the H chain of (7) and the L chain of (8);

(10) an antibody that comprises an H chain having the amino acid sequence of SEQ ID NO: 2294 as VH;

(11) an antibody that comprises an L chain having the amino acid sequence of SEQ ID NO: 2296 as VL;

(12) an antibody that comprises the H chain of (10) and the L chain of (11);

(13) an antibody that comprises an H chain having the amino acid sequence of SEQ ID NO: 38 as CDR1, the amino acid sequence of SEQ ID NO: 40 as CDR2, and the amino acid sequence of SEQ ID NO: 42 as CDR3;

(14) an antibody that comprises an L chain having the amino acid sequence of SEQ ID NO: 44 as CDR1, the amino acid sequence of SEQ ID NO: 46 as CDR2, and the amino acid sequence of SEQ ID NO: 48 as CDR3;

(15) an antibody that comprises the H chain of (13) and the L chain of (14);

(16) an antibody that comprises an H chain having the amino acid sequence of SEQ ID NO: 2298 as VH;

(17) an antibody that comprises an L chain having the amino acid sequence of SEQ ID NO: 2300 as VL;

(18) an antibody that comprises the H chain of (16) and the L chain of (17);

(19) an antibody that comprises an H chain having the amino acid sequence of SEQ ID NO: 54 as CDR1, the amino acid sequence of SEQ ID NO: 56 as CDR2, and the amino acid sequence of SEQ ID NO: 58 as CDR3;

(20) an antibody that comprises an L chain having the amino acid sequence of SEQ ID NO: 60 as CDR1, the amino acid sequence of SEQ ID NO: 62 as CDR2, and the amino acid sequence of SEQ ID NO: 64 as CDR3;

(21) an antibody that comprises the H chain of (19) and the L chain of (20);

(22) an antibody that comprises an H chain having the amino acid sequence of SEQ ID NO: 2302 as VH;

(23) an antibody that comprises an L chain having the amino acid sequence of SEQ ID NO: 2304 as VL;

(24) an antibody that comprises the H chain of (22) and the L chain of (23);

(25) an antibody that comprises an H chain having the amino acid sequence of SEQ ID NO: 70 as CDR1, the amino acid sequence of SEQ ID NO: 72 as CDR2, and the amino acid sequence of SEQ ID NO: 74 as CDR3;

(26) an antibody that comprises an L chain having the amino acid sequence of SEQ ID NO: 76 as CDR1, the amino acid sequence of SEQ ID NO: 78 as CDR2, and the amino acid sequence of SEQ ID NO: 80 as CDR3;

(27) an antibody that comprises the H chain of (25) and the L chain of (26);

(28) an antibody that comprises an H chain having the amino acid sequence of SEQ ID NO: 2306 as VH;

(29) an antibody that comprises an L chain having the amino acid sequence of SEQ ID NO: 2308 as VL;

(30) an antibody that comprises the H chain of (28) and the L chain of (29);

(31) an antibody that comprises an H chain having the amino acid sequence of SEQ ID NO: 86 as CDR1, the amino acid sequence of SEQ ID NO: 88 as CDR2, and the amino acid sequence of SEQ ID NO: 90 as CDR3;

(32) an antibody that comprises an L chain having the amino acid sequence of SEQ ID NO: 92 as CDR1, the amino acid sequence of SEQ ID NO: 94 as CDR2, and the amino acid sequence of SEQ ID NO: 96 as CDR3;

(33) an antibody that comprises the H chain of (31) and the L chain of (32);

(34) an antibody that comprises an H chain having the amino acid sequence of SEQ ID NO: 2310 as VH;

(35) an antibody that comprises an L chain having the amino acid sequence of SEQ ID NO: 2312 as VL;

(36) an antibody that comprises the H chain of (34) and the L chain of (35);

(37) an antibody that comprises an H chain having the amino acid sequence of SEQ ID NO: 102 as CDR1, the amino acid sequence of SEQ ID NO: 104 as CDR2, and the amino acid sequence of SEQ ID NO: 106 as CDR3;

(38) an antibody that comprises an L chain having the amino acid sequence of SEQ ID NO: 108 as CDR1, the amino acid sequence of SEQ ID NO: 110 as CDR2, and the amino acid sequence of SEQ ID NO: 112 as CDR3;

(39) an antibody that comprises the H chain of (37) and the L chain of (38);

(40) an antibody that comprises an H chain having the amino acid sequence of SEQ ID NO: 2314 as VH;

(41) an antibody that comprises an L chain having the amino acid sequence of SEQ ID NO: 2316 as VL;

(42) an antibody that comprises the H chain of (40) and the L chain of (41);

(43) an antibody that comprises an H chain having the amino acid sequence of SEQ ID NO: 118 as CDR1, the amino acid sequence of SEQ ID NO: 120 as CDR2, and the amino acid sequence of SEQ ID NO: 122 as CDR3;

(44) an antibody that comprises an L chain having the amino acid sequence of SEQ ID NO: 124 as CDR1, the amino acid sequence of SEQ ID NO: 126 as CDR2, and the amino acid sequence of SEQ ID NO: 128 as CDR3;

(45) an antibody that comprises the H chain of (43) and the L chain of (44);

(46) an antibody that comprises an H chain having the amino acid sequence of SEQ ID NO: 2318 as VH;

(47) an antibody that comprises an L chain having the amino acid sequence of SEQ ID NO: 2320 as VL;

(48) an antibody that comprises the H chain of (46) and the L chain of (47);

(49) an antibody that comprises an H chain having the amino acid sequence of SEQ ID NO: 134 as CDR1, the amino acid sequence of SEQ ID NO: 136 as CDR2, and the amino acid sequence of SEQ ID NO: 138 as CDR3;

(50) an antibody that comprises an L chain having the amino acid sequence of SEQ ID NO: 140 as CDR1, the amino acid sequence of SEQ ID NO: 142 as CDR2, and the amino acid sequence of SEQ ID NO: 144 as CDR3;

(51) an antibody that comprises the H chain of (49) and the L chain of (50);

(52) an antibody that comprises an H chain having the amino acid sequence of SEQ ID NO: 2322 as VH;

(53) an antibody that comprises an L chain having the amino acid sequence of SEQ ID NO: 2324 as VL;

(54) an antibody that comprises the H chain of (52) and the L chain of (53);

(55) an antibody that comprises an H chain having the amino acid sequence of SEQ ID NO: 150 as CDR1, the amino acid sequence of SEQ ID NO: 152 as CDR2, and the amino acid sequence of SEQ ID NO: 154 as CDR3;

(56) an antibody that comprises an L chain having the amino acid sequence of SEQ ID NO: 156 as CDR1, the amino acid sequence of SEQ ID NO: 158 as CDR2, and the amino acid sequence of SEQ ID NO: 160 as CDR3;

(57) an antibody that comprises the H chain of (55) and the L chain of (56);

(58) an antibody that comprises an H chain having the amino acid sequence of SEQ ID NO: 2326 as VH;

(59) an antibody that comprises an L chain having the amino acid sequence of SEQ ID NO: 2328 as VL;

(60) an antibody that comprises the H chain of (58) and the L chain of (59);

(61) an antibody that comprises an H chain having the amino acid sequence of SEQ ID NO: 166 as CDR1, the amino acid sequence of SEQ ID NO: 168 as CDR2, and the amino acid sequence of SEQ ID NO: 170 as CDR3;

(62) an antibody that comprises an L chain having the amino acid sequence of SEQ ID NO: 172 as CDR1, the amino acid sequence of SEQ ID NO: 174 as CDR2, and the amino acid sequence of SEQ ID NO: 176 as CDR3;

(63) an antibody that comprises the H chain of (61) and the L chain of (62);

(64) an antibody that comprises an H chain having the amino acid sequence of SEQ ID NO: 2330 as VH;

(65) an antibody that comprises an L chain having the amino acid sequence of SEQ ID NO: 2332 as VL;

(66) an antibody that comprises the H chain of (64) and the L chain of (65);

(67) an antibody that comprises an H chain having the amino acid sequence of SEQ ID NO: 182 as CDR1, the amino acid sequence of SEQ ID NO: 184 as CDR2, and the amino acid sequence of SEQ ID NO: 186 as CDR3;

(68) an antibody that comprises an L chain having the amino acid sequence of SEQ ID NO: 188 as CDR1, the amino acid sequence of SEQ ID NO: 190 as CDR2, and the amino acid sequence of SEQ ID NO: 192 as CDR3;

(69) an antibody that comprises the H chain of (67) and the L chain of (68);

(70) an antibody that comprises an H chain having the amino acid sequence of SEQ ID NO: 2334 as VH;

(71) an antibody that comprises an L chain having the amino acid sequence of SEQ ID NO: 2336 as VL;

(72) an antibody that comprises the H chain of (70) and the L chain of (71);

(73) an antibody that comprises an H chain having the amino acid sequence of SEQ ID NO: 198 as CDR1, the amino acid sequence of SEQ ID NO: 200 as CDR2, and the amino acid sequence of SEQ ID NO: 202 as CDR3;

(74) an antibody that comprises an L chain having the amino acid sequence of SEQ ID NO: 204 as CDR1, the amino acid sequence of SEQ ID NO: 206 as CDR2, and the amino acid sequence of SEQ ID NO: 208 as CDR3;

(75) an antibody that comprises the H chain of (73) and the L chain of (74);

(76) an antibody that comprises an H chain having the amino acid sequence of SEQ ID NO: 2338 as VH;

(77) an antibody that comprises an L chain having the amino acid sequence of SEQ ID NO: 2340 as VL;

(78) an antibody that comprises the H chain of (76) and the L chain of (77);

(79) an antibody that comprises an H chain having the amino acid sequence of SEQ ID NO: 214 as CDR1, the amino acid sequence of SEQ ID NO: 216 as CDR2, and the amino acid sequence of SEQ ID NO: 218 as CDR3;

(80) an antibody that comprises an L chain having the amino acid sequence of SEQ ID NO: 220 as CDR1, the amino acid sequence of SEQ ID NO: 222 as CDR2, and the amino acid sequence of SEQ ID NO: 224 as CDR3;

(81) an antibody that comprises the H chain of (79) and the L chain of (80);

(82) an antibody that comprises an H chain having the amino acid sequence of SEQ ID NO: 2342 as VH;

(83) an antibody that comprises an L chain having the amino acid sequence of SEQ ID NO: 2344 as VL;

(84) an antibody that comprises the H chain of (82) and the L chain of (83);

(85) an antibody that comprises an H chain having the amino acid sequence of SEQ ID NO: 230 as CDR1, the amino acid sequence of SEQ ID NO: 232 as CDR2, and the amino acid sequence of SEQ ID NO: 234 as CDR3;

(86) an antibody that comprises an L chain having the amino acid sequence of SEQ ID NO: 236 as CDR1, the amino acid sequence of SEQ ID NO: 238 as CDR2, and the amino acid sequence of SEQ ID NO: 240 as CDR3;

(87) an antibody that comprises the H chain of (85) and the L chain of (86);

(88) an antibody that comprises an H chain having the amino acid sequence of SEQ ID NO: 2346 as VH;

(89) an antibody that comprises an L chain having the amino acid sequence of SEQ ID NO: 2348 as VL;

(90) an antibody that comprises the H chain of (88) and the L chain of (89);

(91) an antibody that comprises an H chain having the amino acid sequence of SEQ ID NO: 246 as CDR1, the amino acid sequence of SEQ ID NO: 248 as CDR2, and the amino acid sequence of SEQ ID NO: 250 as CDR3;

(92) an antibody that comprises an L chain having the amino acid sequence of SEQ ID NO: 252 as CDR1, the amino acid sequence of SEQ ID NO: 254 as CDR2, and the amino acid sequence of SEQ ID NO: 256 as CDR3;

(93) an antibody that comprises the H chain of (91) and the L chain of (92);

(94) an antibody that comprises an H chain having the amino acid sequence of SEQ ID NO: 2350 as VH;

(95) an antibody that comprises an L chain having the amino acid sequence of SEQ ID NO: 2352 as VL;

(96) an antibody that comprises the H chain of (94) and the L chain of (95);

(97) an antibody that comprises an H chain having the amino acid sequence of SEQ ID NO: 262 as CDR1, the amino acid sequence of SEQ ID NO: 264 as CDR2, and the amino acid sequence of SEQ ID NO: 266 as CDR3;

(98) an antibody that comprises an L chain having the amino acid sequence of SEQ ID NO: 268 as CDR1, the amino acid sequence of SEQ ID NO: 270 as CDR2, and the amino acid sequence of SEQ ID NO: 272 as CDR3;

(99) an antibody that comprises the H chain of (97) and the L chain of (98);

(100) an antibody that comprises an H chain having the amino acid sequence of SEQ ID NO: 2354 as VH;

(101) an antibody that comprises an L chain having the amino acid sequence of SEQ ID NO: 2356 as VL;

(102) an antibody that comprises the H chain of (100) and the L chain of (101);

(103) an antibody that comprises an H chain having the amino acid sequence of SEQ ID NO: 278 as CDR1, the amino acid sequence of SEQ ID NO: 280 as CDR2, and the amino acid sequence of SEQ ID NO: 282 as CDR3;

(104) an antibody that comprises an L chain having the amino acid sequence of SEQ ID NO: 284 as CDR1, the amino acid sequence of SEQ ID NO: 286 as CDR2, and the amino acid sequence of SEQ ID NO: 288 as CDR3;

(105) an antibody that comprises the H chain of (103) and the L chain of (104);

(106) an antibody that comprises an H chain having the amino acid sequence of SEQ ID NO: 2358 as VH;

(107) an antibody that comprises an L chain having the amino acid sequence of SEQ ID NO: 2360 as VL;

(108) an antibody that comprises the H chain of (106) and the L chain of (107);

(109) an antibody that comprises an H chain having the amino acid sequence of SEQ ID NO: 294 as CDR1, the amino acid sequence of SEQ ID NO: 296 as CDR2, and the amino acid sequence of SEQ ID NO: 298 as CDR3;

(110) an antibody that comprises an L chain having the amino acid sequence of SEQ ID NO: 300 as CDR1, the amino acid sequence of SEQ ID NO: 302 as CDR2, and the amino acid sequence of SEQ ID NO: 304 as CDR3;

(111) an antibody that comprises the H chain of (109) and the L chain of (110);

(112) an antibody that comprises an H chain having the amino acid sequence of SEQ ID NO: 2362 as VH;

(113) an antibody that comprises an L chain having the amino acid sequence of SEQ ID NO: 2364 as VL;

(114) an antibody that comprises the H chain of (112) and the L chain of (113);

(115) an antibody that comprises an H chain having the amino acid sequence of SEQ ID NO: 310 as CDR1, the amino acid sequence of SEQ ID NO: 312 as CDR2, and the amino acid sequence of SEQ ID NO: 314 as CDR3;

(116) an antibody that comprises an L chain having the amino acid sequence of SEQ ID NO: 316 as CDR1, the amino acid sequence of SEQ ID NO: 318 as CDR2, and the amino acid sequence of SEQ ID NO: 320 as CDR3;

(117) an antibody that comprises the H chain of (115) and the L chain of (116);

(118) an antibody that comprises an H chain having the amino acid sequence of SEQ ID NO: 2366 as VH;

(119) an antibody that comprises an L chain having the amino acid sequence of SEQ ID NO: 2368 as VL;

(120) an antibody that comprises the H chain of (118) and the L chain of (119);

(121) an antibody that comprises an H chain having the amino acid sequence of SEQ ID NO: 326 as CDR1, the amino acid sequence of SEQ ID NO: 328 as CDR2, and the amino acid sequence of SEQ ID NO: 330 as CDR3;

(122) an antibody that comprises an L chain having the amino acid sequence of SEQ ID NO: 332 as CDR1, the amino acid sequence of SEQ ID NO: 334 as CDR2, and the amino acid sequence of SEQ ID NO: 336 as CDR3;

(123) an antibody that comprises the H chain of (121) and the L chain of (122);

(124) an antibody that comprises an H chain having the amino acid sequence of SEQ ID NO: 2370 as VH;

(125) an antibody that comprises an L chain having the amino acid sequence of SEQ ID NO: 2372 as VL;

(126) an antibody that comprises the H chain of (124) and the L chain of (125);

(127) an antibody that comprises an H chain having the amino acid sequence of SEQ ID NO: 342 as CDR1, the amino acid sequence of SEQ ID NO: 344 as CDR2, and the amino acid sequence of SEQ ID NO: 346 as CDR3;

(128) an antibody that comprises an L chain having the amino acid sequence of SEQ ID NO: 348 as CDR1, the amino acid sequence of SEQ ID NO: 350 as CDR2, and the amino acid sequence of SEQ ID NO: 352 as CDR3;

(129) an antibody that comprises the H chain of (127) and the L chain of (128);

(130) an antibody that comprises an H chain having the amino acid sequence of SEQ ID NO: 2374 as VH;

(131) an antibody that comprises an L chain having the amino acid sequence of SEQ ID NO: 2376 as VL;

(132) an antibody that comprises the H chain of (130) and the L chain of (131);

(133) an antibody that comprises an H chain having the amino acid sequence of SEQ ID NO: 358 as CDR1, the amino acid sequence of SEQ ID NO: 360 as CDR2, and the amino acid sequence of SEQ ID NO: 362 as CDR3;

(134) an antibody that comprises an L chain having the amino acid sequence of SEQ ID NO: 364 as CDR1, the amino acid sequence of SEQ ID NO: 366 as CDR2, and the amino acid sequence of SEQ ID NO: 368 as CDR3;

(135) an antibody that comprises the H chain of (133) and the L chain of (134);

(136) an antibody that comprises an H chain having the amino acid sequence of SEQ ID NO: 2378 as VH;

(137) an antibody that comprises an L chain having the amino acid sequence of SEQ ID NO: 2380 as VL;

(138) an antibody that comprises the H chain of (136) and the L chain of (137);

(139) an antibody that comprises an H chain having the amino acid sequence of SEQ ID NO: 374 as CDR1, the amino acid sequence of SEQ ID NO: 376 as CDR2, and the amino acid sequence of SEQ ID NO: 378 as CDR3;

(140) an antibody that comprises an L chain having the amino acid sequence of SEQ ID NO: 380 as CDR1, the amino acid sequence of SEQ ID NO: 382 as CDR2, and the amino acid sequence of SEQ ID NO: 384 as CDR3;

(141) an antibody that comprises the H chain of (139) and the L chain of (140);

(142) an antibody that comprises an H chain having the amino acid sequence of SEQ ID NO: 2382 as VH;

(143) an antibody that comprises an L chain having the amino acid sequence of SEQ ID NO: 2384 as VL;

(144) an antibody that comprises the H chain of (142) and the L chain of (143);

(145) an antibody that comprises an H chain having the amino acid sequence of SEQ ID NO: 390 as CDR1, the amino acid sequence of SEQ ID NO: 392 as CDR2, and the amino acid sequence of SEQ ID NO: 394 as CDR3;

(146) an antibody that comprises an L chain having the amino acid sequence of SEQ ID NO: 396 as CDR1, the amino acid sequence of SEQ ID NO: 398 as CDR2, and the amino acid sequence of SEQ ID NO: 400 as CDR3;

(147) an antibody that comprises the H chain of (145) and the L chain of (146);

(148) an antibody that comprises an H chain having the amino acid sequence of SEQ ID NO: 2386 as VH;

(149) an antibody that comprises an L chain having the amino acid sequence of SEQ ID NO: 2388 as VL;

(150) an antibody that comprises the H chain of (148) and the L chain of (149);

(151) an antibody that comprises an H chain having the amino acid sequence of SEQ ID NO: 406 as CDR1, the amino acid sequence of SEQ ID NO: 408 as CDR2, and the amino acid sequence of SEQ ID NO: 410 as CDR3;

(152) an antibody that comprises an L chain having the amino acid sequence of SEQ ID NO: 412 as CDR1, the amino acid sequence of SEQ ID NO: 414 as CDR2, and the amino acid sequence of SEQ ID NO: 416 as CDR3;

(153) an antibody that comprises the H chain of (151) and the L chain of (152);

(154) an antibody that comprises an H chain having the amino acid sequence of SEQ ID NO: 2390 as VH;

(155) an antibody that comprises an L chain having the amino acid sequence of SEQ ID NO: 2392 as VL;

(156) an antibody that comprises the H chain of (154) and the L chain of (155);

(157) an antibody that comprises an H chain having the amino acid sequence of SEQ ID NO: 422 as CDR1, the amino acid sequence of SEQ ID NO: 424 as CDR2, and the amino acid sequence of SEQ ID NO: 426 as CDR3;

(158) an antibody that comprises an L chain having the amino acid sequence of SEQ ID NO: 428 as CDR1, the amino acid sequence of SEQ ID NO: 430 as CDR2, and the amino acid sequence of SEQ ID NO: 432 as CDR3;

(159) an antibody that comprises the H chain of (157) and the L chain of (158);

(160) an antibody that comprises an H chain having the amino acid sequence of SEQ ID NO: 2394 as VH;

(161) an antibody that comprises an L chain having the amino acid sequence of SEQ ID NO: 2396 as VL;

(162) an antibody that comprises the H chain of (160) and the L chain of (161);

(163) an antibody that comprises an H chain having the amino acid sequence of SEQ ID NO: 438 as CDR1, the amino acid sequence of SEQ ID NO: 440 as CDR2, and the amino acid sequence of SEQ ID NO: 442 as CDR3;

(164) an antibody that comprises an L chain having the amino acid sequence of SEQ ID NO: 444 as CDR1, the amino acid sequence of SEQ ID NO: 446 as CDR2, and the amino acid sequence of SEQ ID NO: 448 as CDR3;

(165) an antibody that comprises the H chain of (163) and the L chain of (164);

(166) an antibody that comprises an H chain having the amino acid sequence of SEQ ID NO: 2398 as VH;

(167) an antibody that comprises an L chain having the amino acid sequence of SEQ ID NO: 2400 as VL;

(168) an antibody that comprises the H chain of (166) and the L chain of (167);

(169) an antibody that comprises an H chain having the amino acid sequence of SEQ ID NO: 454 as CDR1, the amino acid sequence of SEQ ID NO: 456 as CDR2, and the amino acid sequence of SEQ ID NO: 458 as CDR3;

(170) an antibody that comprises an L chain having the amino acid sequence of SEQ ID NO: 460 as CDR1, the amino acid sequence of SEQ ID NO: 462 as CDR2, and the amino acid sequence of SEQ ID NO: 464 as CDR3;

(171) an antibody that comprises the H chain of (169) and the L chain of (170);

(172) an antibody that comprises an H chain having the amino acid sequence of SEQ ID NO: 2402 as VH;

(173) an antibody that comprises an L chain having the amino acid sequence of SEQ ID NO: 2404 as VL;

(174) an antibody that comprises the H chain of (172) and the L chain of (173);

(175) an antibody that comprises an H chain having the amino acid sequence of SEQ ID NO: 470 as CDR1, the amino acid sequence of SEQ ID NO: 472 as CDR2, and the amino acid sequence of SEQ ID NO: 474 as CDR3;

(176) an antibody that comprises an L chain having the amino acid sequence of SEQ ID NO: 476 as CDR1, the amino acid sequence of SEQ ID NO: 478 as CDR2, and the amino acid sequence of SEQ ID NO: 480 as CDR3;

(177) an antibody that comprises the H chain of (175) and the L chain of (176);

(178) an antibody that comprises an H chain having the amino acid sequence of SEQ ID NO: 2406 as VH;

(179) an antibody that comprises an L chain having the amino acid sequence of SEQ ID NO: 2408 as VL;

(180) an antibody that comprises the H chain of (178) and the L chain of (179);

(181) an antibody that comprises an H chain having the amino acid sequence of SEQ ID NO: 486 as CDR1, the amino acid sequence of SEQ ID NO: 488 as CDR2, and the amino acid sequence of SEQ ID NO: 490 as CDR3;

(182) an antibody that comprises an L chain having the amino acid sequence of SEQ ID NO: 492 as CDR1, the amino acid sequence of SEQ ID NO: 494 as CDR2, and the amino acid sequence of SEQ ID NO: 496 as CDR3;

(183) an antibody that comprises the H chain of (181) and the L chain of (182);

(184) an antibody that comprises an H chain having the amino acid sequence of SEQ ID NO: 2410 as VH;

(185) an antibody that comprises an L chain having the amino acid sequence of SEQ ID NO: 2412 as VL;

(186) an antibody that comprises the H chain of (184) and the L chain of (185);

(187) an antibody that comprises an H chain having the amino acid sequence of SEQ ID NO: 502 as CDR1, the amino acid sequence of SEQ ID NO: 504 as CDR2, and the amino acid sequence of SEQ ID NO: 506 as CDR3;

(188) an antibody that comprises an L chain having the amino acid sequence of SEQ ID NO: 508 as CDR1, the amino acid sequence of SEQ ID NO: 510 as CDR2, and the amino acid sequence of SEQ ID NO: 512 as CDR3;

(189) an antibody that comprises the H chain of (187) and the L chain of (188);

(190) an antibody that comprises an H chain having the amino acid sequence of SEQ ID NO: 2414 as VH;

(191) an antibody that comprises an L chain having the amino acid sequence of SEQ ID NO: 2416 as VL;

(192) an antibody that comprises the H chain of (190) and the L chain of (191);

(193) an antibody that comprises an H chain having the amino acid sequence of SEQ ID NO: 518 as CDR1, the amino acid sequence of SEQ ID NO: 520 as CDR2, and the amino acid sequence of SEQ ID NO: 522 as CDR3;

(194) an antibody that comprises an L chain having the amino acid sequence of SEQ ID NO: 524 as CDR1, the amino acid sequence of SEQ ID NO: 526 as CDR2, and the amino acid sequence of SEQ ID NO: 528 as CDR3;

(195) an antibody that comprises the H chain of (193) and the L chain of (194);

(196) an antibody that comprises an H chain having the amino acid sequence of SEQ ID NO: 2418 as VH;

(197) an antibody that comprises an L chain having the amino acid sequence of SEQ ID NO: 2420 as VL;

(198) an antibody that comprises the H chain of (196) and the L chain of (197);

(199) an antibody that comprises an H chain having the amino acid sequence of SEQ ID NO: 534 as CDR1, the amino acid sequence of SEQ ID NO: 536 as CDR2, and the amino acid sequence of SEQ ID NO: 538 as CDR3;

(200) an antibody that comprises an L chain having the amino acid sequence of SEQ ID NO: 540 as CDR1, the amino acid sequence of SEQ ID NO: 542 as CDR2, and the amino acid sequence of SEQ ID NO: 544 as CDR3;

(201) an antibody that comprises the H chain of (199) and the L chain of (200);

(202) an antibody that comprises an H chain having the amino acid sequence of SEQ ID NO: 2422 as VH;

(203) an antibody that comprises an L chain having the amino acid sequence of SEQ ID NO: 2424 as VL;

(204) an antibody that comprises the H chain of (202) and the L chain of (203);

(205) an antibody that comprises an H chain having the amino acid sequence of SEQ ID NO: 550 as CDR1, the amino acid sequence of SEQ ID NO: 552 as CDR2, and the amino acid sequence of SEQ ID NO: 554 as CDR3;

(206) an antibody that comprises an L chain having the amino acid sequence of SEQ ID NO: 556 as CDR1, the amino acid sequence of SEQ ID NO: 558 as CDR2, and the amino acid sequence of SEQ ID NO: 560 as CDR3;

(207) an antibody that comprises the H chain of (205) and the L chain of (206);

(208) an antibody that comprises an H chain having the amino acid sequence of SEQ ID NO: 2426 as VH;

(209) an antibody that comprises an L chain having the amino acid sequence of SEQ ID NO: 2428 as VL;

(210) an antibody that comprises the H chain of (208) and the L chain of (209);

(211) an antibody that comprises an H chain having the amino acid sequence of SEQ ID NO: 566 as CDR1, the amino acid sequence of SEQ ID NO: 568 as CDR2, and the amino acid sequence of SEQ ID NO: 570 as CDR3;

(212) an antibody that comprises an L chain having the amino acid sequence of SEQ ID NO: 572 as CDR1, the amino acid sequence of SEQ ID NO: 574 as CDR2, and the amino acid sequence of SEQ ID NO: 576 as CDR3;

(213) an antibody that comprises the H chain of (211) and the L chain of (212);

(214) an antibody that comprises an H chain having the amino acid sequence of SEQ ID NO: 2430 as VH;

(215) an antibody that comprises an L chain having the amino acid sequence of SEQ ID NO: 2432 as VL;

(216) an antibody that comprises the H chain of (214) and the L chain of (215);

(217) an antibody that comprises an H chain having the amino acid sequence of SEQ ID NO: 582 as CDR1, the amino acid sequence of SEQ ID NO: 584 as CDR2, and the amino acid sequence of SEQ ID NO: 586 as CDR3;

(218) an antibody that comprises an L chain having the amino acid sequence of SEQ ID NO: 588 as CDR1, the amino acid sequence of SEQ ID NO: 590 as CDR2, and the amino acid sequence of SEQ ID NO: 592 as CDR3;

(219) an antibody that comprises the H chain of (217) and the L chain of (218);

(220) an antibody that comprises an H chain having the amino acid sequence of SEQ ID NO: 2434 as VH;

(221) an antibody that comprises an L chain having the amino acid sequence of SEQ ID NO: 2436 as VL;

(222) an antibody that comprises the H chain of (220) and the L chain of (221);

(223) an antibody that comprises an H chain having the amino acid sequence of SEQ ID NO: 598 as CDR1, the amino acid sequence of SEQ ID NO: 600 as CDR2, and the amino acid sequence of SEQ ID NO: 602 as CDR3;

(224) an antibody that comprises an L chain having the amino acid sequence of SEQ ID NO: 604 as CDR1, the amino acid sequence of SEQ ID NO: 606 as CDR2, and the amino acid sequence of SEQ ID NO: 608 as CDR3;

(225) an antibody that comprises the H chain of (223) and the L chain of (224);

(226) an antibody that comprises an H chain having the amino acid sequence of SEQ ID NO: 2438 as VH;

(227) an antibody that comprises an L chain having the amino acid sequence of SEQ ID NO: 2440 as VL;

(228) an antibody that comprises the H chain of (226) and the L chain of (227);

(229) an antibody that comprises an H chain having the amino acid sequence of SEQ ID NO: 614 as CDR1, the amino acid sequence of SEQ ID NO: 616 as CDR2, and the amino acid sequence of SEQ ID NO: 618 as CDR3;

(230) an antibody that comprises an L chain having the amino acid sequence of SEQ ID NO: 620 as CDR1, the amino acid sequence of SEQ ID NO: 622 as CDR2, and the amino acid sequence of SEQ ID NO: 624 as CDR3;

(231) an antibody that comprises the H chain of (229) and the L chain of (230);

(232) an antibody that comprises an H chain having the amino acid sequence of SEQ ID NO: 2442 as VH;

(233) an antibody that comprises an L chain having the amino acid sequence of SEQ ID NO: 2444 as VL;

(234) an antibody that comprises the H chain of (232) and the L chain of (233);

(235) an antibody that comprises an H chain having the amino acid sequence of SEQ ID NO: 630 as CDR1, the amino acid sequence of SEQ ID NO: 632 as CDR2, and the amino acid sequence of SEQ ID NO: 634 as CDR3;

(236) an antibody that comprises an L chain having the amino acid sequence of SEQ ID NO: 636 as CDR1, the amino acid sequence of SEQ ID NO: 638 as CDR2, and the amino acid sequence of SEQ ID NO: 640 as CDR3;

(237) an antibody that comprises the H chain of (235) and the L chain of (236);

(238) an antibody that comprises an H chain having the amino acid sequence of SEQ ID NO: 2446 as VH;

(239) an antibody that comprises an L chain having the amino acid sequence of SEQ ID NO: 2448 as VL;

(240) an antibody that comprises the H chain of (238) and the L chain of (239);

(241) an antibody that comprises an H chain having the amino acid sequence of SEQ ID NO: 646 as CDR1, the amino acid sequence of SEQ ID NO: 648 as CDR2, and the amino acid sequence of SEQ ID NO: 650 as CDR3;

(242) an antibody that comprises an L chain having the amino acid sequence of SEQ ID NO: 652 as CDR1, the amino acid sequence of SEQ ID NO: 654 as CDR2, and the amino acid sequence of SEQ ID NO: 656 as CDR3;

(243) an antibody that comprises the H chain of (241) and the L chain of (242);

(244) an antibody that comprises an H chain having the amino acid sequence of SEQ ID NO: 2450 as VH;

(245) an antibody that comprises an L chain having the amino acid sequence of SEQ ID NO: 2452 as VL;

(246) an antibody that comprises the H chain of (244) and the L chain of (245);

(247) an antibody that comprises an H chain having the amino acid sequence of SEQ ID NO: 662 as CDR1, the amino acid sequence of SEQ ID NO: 664 as CDR2, and the amino acid sequence of SEQ ID NO: 666 as CDR3;

(248) an antibody that comprises an L chain having the amino acid sequence of SEQ ID NO: 668 as CDR1, the amino acid sequence of SEQ ID NO: 670 as CDR2, and the amino acid sequence of SEQ ID NO: 672 as CDR3;

(249) an antibody that comprises the H chain of (247) and the L chain of (248);

(250) an antibody that comprises an H chain having the amino acid sequence of SEQ ID NO: 2454 as VH;

(251) an antibody that comprises an L chain having the amino acid sequence of SEQ ID NO: 2456 as VL;

(252) an antibody that comprises the H chain of (250) and the L chain of (251);

(253) an antibody that comprises an H chain having the amino acid sequence of SEQ ID NO: 678 as CDR1, the amino acid sequence of SEQ ID NO: 680 as CDR2, and the amino acid sequence of SEQ ID NO: 682 as CDR3;

(254) an antibody that comprises an L chain having the amino acid sequence of SEQ ID NO: 684 as CDR1, the amino acid sequence of SEQ ID NO: 686 as CDR2, and the amino acid sequence of SEQ ID NO: 688 as CDR3;

(255) an antibody that comprises the H chain of (253) and the L chain of (254);

(256) an antibody that comprises an H chain having the amino acid sequence of SEQ ID NO: 2458 as VH;

(257) an antibody that comprises an L chain having the amino acid sequence of SEQ ID NO: 2460 as VL;

(258) an antibody that comprises the H chain of (256) and the L chain of (257);

(259) an antibody that comprises an H chain having the amino acid sequence of SEQ ID NO: 694 as CDR1, the amino acid sequence of SEQ ID NO: 696 as CDR2, and the amino acid sequence of SEQ ID NO: 698 as CDR3;

(260) an antibody that comprises an L chain having the amino acid sequence of SEQ ID NO: 700 as CDR1, the amino acid sequence of SEQ ID NO: 702 as CDR2, and the amino acid sequence of SEQ ID NO: 704 as CDR3;

(261) an antibody that comprises the H chain of (259) and the L chain of (260);

(262) an antibody that comprises an H chain having the amino acid sequence of SEQ ID NO: 2462 as VH;

(263) an antibody that comprises an L chain having the amino acid sequence of SEQ ID NO: 2464 as VL;

(264) an antibody that comprises the H chain of (262) and the L chain of (263);

(265) an antibody that comprises an H chain having the amino acid sequence of SEQ ID NO: 710 as CDR1, the amino acid sequence of SEQ ID NO: 712 as CDR2, and the amino acid sequence of SEQ ID NO: 714 as CDR3;

(266) an antibody that comprises an L chain having the amino acid sequence of SEQ ID NO: 716 as CDR1, the amino acid sequence of SEQ ID NO: 718 as CDR2, and the amino acid sequence of SEQ ID NO: 720 as CDR3;

(267) an antibody that comprises the H chain of (265) and the L chain of (266);

(268) an antibody that comprises an H chain having the amino acid sequence of SEQ ID NO: 2466 as VH;

(269) an antibody that comprises an L chain having the amino acid sequence of SEQ ID NO: 2468 as VL;

(270) an antibody that comprises the H chain of (268) and the L chain of (269);

(271) an antibody that comprises an H chain having the amino acid sequence of SEQ ID NO: 726 as CDR1, the amino acid sequence of SEQ ID NO: 728 as CDR2, and the amino acid sequence of SEQ ID NO: 730 as CDR3;

(272) an antibody that comprises an L chain having the amino acid sequence of SEQ ID NO: 732 as CDR1, the amino acid sequence of SEQ ID NO: 734 as CDR2, and the amino acid sequence of SEQ ID NO: 736 as CDR3;

(273) an antibody that comprises the H chain of (271) and the L chain of (272);

(274) an antibody that comprises an H chain having the amino acid sequence of SEQ ID NO: 2470 as VH;

(275) an antibody that comprises an L chain having the amino acid sequence of SEQ ID NO: 2472 as VL;

(276) an antibody that comprises the H chain of (274) and the L chain of (275);

(277) an antibody that comprises an H chain having the amino acid sequence of SEQ ID NO: 742 as CDR1, the amino acid sequence of SEQ ID NO: 744 as CDR2, and the amino acid sequence of SEQ ID NO: 746 as CDR3;

(278) an antibody that comprises an L chain having the amino acid sequence of SEQ ID NO: 748 as CDR1, the amino acid sequence of SEQ ID NO: 750 as CDR2, and the amino acid sequence of SEQ ID NO: 752 as CDR3;

(279) an antibody that comprises the H chain of (277) and the L chain of (278);

(280) an antibody that comprises an H chain having the amino acid sequence of SEQ ID NO: 2474 as VH;

(281) an antibody that comprises an L chain having the amino acid sequence of SEQ ID NO: 2476 as VL;

(282) an antibody that comprises the H chain of (280) and the L chain of (281);

(283) an antibody that comprises an H chain having the amino acid sequence of SEQ ID NO: 758 as CDR1, the amino acid sequence of SEQ ID NO: 760 as CDR2, and the amino acid sequence of SEQ ID NO: 762 as CDR3;

(284) an antibody that comprises an L chain having the amino acid sequence of SEQ ID NO: 764 as CDR1, the amino acid sequence of SEQ ID NO: 766 as CDR2, and the amino acid sequence of SEQ ID NO: 768 as CDR3;

(285) an antibody that comprises the H chain of (283) and the L chain of (284);

(286) an antibody that comprises an H chain having the amino acid sequence of SEQ ID NO: 2478 as VH;

(287) an antibody that comprises an L chain having the amino acid sequence of SEQ ID NO: 2480 as VL;

(288) an antibody that comprises the H chain of (286) and the L chain of (287);

(289) an antibody that comprises an H chain having the amino acid sequence of SEQ ID NO: 774 as CDR1, the amino acid sequence of SEQ ID NO: 776 as CDR2, and the amino acid sequence of SEQ ID NO: 778 as CDR3;

(290) an antibody that comprises an L chain having the amino acid sequence of SEQ ID NO: 780 as CDR1, the amino acid sequence of SEQ ID NO: 782 as CDR2, and the amino acid sequence of SEQ ID NO: 784 as CDR3;

(291) an antibody that comprises the H chain of (289) and the L chain of (290);

(292) an antibody that comprises an H chain having the amino acid sequence of SEQ ID NO: 2482 as VH;

(293) an antibody that comprises an L chain having the amino acid sequence of SEQ ID NO: 2484 as VL;

(294) an antibody that comprises the H chain of (292) and the L chain of (293);

(295) an antibody that comprises an H chain having the amino acid sequence of SEQ ID NO: 790 as CDR1, the amino acid sequence of SEQ ID NO: 792 as CDR2, and the amino acid sequence of SEQ ID NO: 794 as CDR3;

(296) an antibody that comprises an L chain having the amino acid sequence of SEQ ID NO: 796 as CDR1, the amino acid sequence of SEQ ID NO: 798 as CDR2, and the amino acid sequence of SEQ ID NO: 800 as CDR3;

(297) an antibody that comprises the H chain of (295) and the L chain of (296);

(298) an antibody that comprises an H chain having the amino acid sequence of SEQ ID NO: 2486 as VH;

(299) an antibody that comprises an L chain having the amino acid sequence of SEQ ID NO: 2488 as VL;

(300) an antibody that comprises the H chain of (298) and the L chain of (299);

(301) an antibody that comprises an H chain having the amino acid sequence of SEQ ID NO: 806 as CDR1, the amino acid sequence of SEQ ID NO: 808 as CDR2, and the amino acid sequence of SEQ ID NO: 810 as CDR3;

(302) an antibody that comprises an L chain having the amino acid sequence of SEQ ID NO: 812 as CDR1, the amino acid sequence of SEQ ID NO: 814 as CDR2, and the amino acid sequence of SEQ ID NO: 816 as CDR3;

(303) an antibody that comprises the H chain of (301) and the L chain of (302);

(304) an antibody that comprises an H chain having the amino acid sequence of SEQ ID NO: 2490 as VH;

(305) an antibody that comprises an L chain having the amino acid sequence of SEQ ID NO: 2492 as VL;

(306) an antibody that comprises the H chain of (304) and the L chain of (305);

(307) an antibody that comprises an H chain having the amino acid sequence of SEQ ID NO: 822 as CDR1, the amino acid sequence of SEQ ID NO: 824 as CDR2, and the amino acid sequence of SEQ ID NO: 826 as CDR3;

(308) an antibody that comprises an L chain having the amino acid sequence of SEQ ID NO: 828 as CDR1, the amino acid sequence of SEQ ID NO: 830 as CDR2, and the amino acid sequence of SEQ ID NO: 832 as CDR3;

(309) an antibody that comprises the H chain of (307) and the L chain of (308);

(310) an antibody that comprises an H chain having the amino acid sequence of SEQ ID NO: 2494 as VH;

(311) an antibody that comprises an L chain having the amino acid sequence of SEQ ID NO: 2496 as VL;

(312) an antibody that comprises the H chain of (310) and the L chain of (311);

(313) an antibody that comprises an H chain having the amino acid sequence of SEQ ID NO: 838 as CDR1, the amino acid sequence of SEQ ID NO: 840 as CDR2, and the amino acid sequence of SEQ ID NO: 842 as CDR3;

(314) an antibody that comprises an L chain having the amino acid sequence of SEQ ID NO: 844 as CDR1, the amino acid sequence of SEQ ID NO: 846 as CDR2, and the amino acid sequence of SEQ ID NO: 848 as CDR3;

(315) an antibody that comprises the H chain of (313) and the L chain of (314);

(316) an antibody that comprises an H chain having the amino acid sequence of SEQ ID NO: 2498 as VH;

(317) an antibody that comprises an L chain having the amino acid sequence of SEQ ID NO: 2500 as VL;

(318) an antibody that comprises the H chain of (316) and the L chain of (317);

(319) an antibody that comprises an H chain having the amino acid sequence of SEQ ID NO: 854 as CDR1, the amino acid sequence of SEQ ID NO: 856 as CDR2, and the amino acid sequence of SEQ ID NO: 858 as CDR3;

(320) an antibody that comprises an L chain having the amino acid sequence of SEQ ID NO: 860 as CDR1, the amino acid sequence of SEQ ID NO: 862 as CDR2, and the amino acid sequence of SEQ ID NO: 864 as CDR3;

(321) an antibody that comprises the H chain of (319) and the L chain of (320);

(322) an antibody that comprises an H chain having the amino acid sequence of SEQ ID NO: 2502 as VH;

(323) an antibody that comprises an L chain having the amino acid sequence of SEQ ID NO: 2504 as VL;

(324) an antibody that comprises the H chain of (322) and the L chain of (323);

(325) an antibody that comprises an H chain having the amino acid sequence of SEQ ID NO: 870 as CDR1, the amino acid sequence of SEQ ID NO: 872 as CDR2, and the amino acid sequence of SEQ ID NO: 874 as CDR3;

(326) an antibody that comprises an L chain having the amino acid sequence of SEQ ID NO: 876 as CDR1, the amino acid sequence of SEQ ID NO: 878 as CDR2, and the amino acid sequence of SEQ ID NO: 880 as CDR3;

(327) an antibody that comprises the H chain of (325) and the L chain of (326);

(328) an antibody that comprises an H chain having the amino acid sequence of SEQ ID NO: 2506 as VH;

(329) an antibody that comprises an L chain having the amino acid sequence of SEQ ID NO: 2508 as VL;

(330) an antibody that comprises the H chain of (328) and the L chain of (329);

(331) an antibody that comprises an H chain having the amino acid sequence of SEQ ID NO: 886 as CDR1, the amino acid sequence of SEQ ID NO: 888 as CDR2, and the amino acid sequence of SEQ ID NO: 890 as CDR3;

(332) an antibody that comprises an L chain having the amino acid sequence of SEQ ID NO: 892 as CDR1, the amino acid sequence of SEQ ID NO: 894 as CDR2, and the amino acid sequence of SEQ ID NO: 896 as CDR3;

(333) an antibody that comprises the H chain of (331) and the L chain of (332);

(334) an antibody that comprises an H chain having the amino acid sequence of SEQ ID NO: 2510 as VH;

(335) an antibody that comprises an L chain having the amino acid sequence of SEQ ID NO: 2512 as VL;

(336) an antibody that comprises the H chain of (334) and the L chain of (335);

(337) an antibody that comprises an H chain having the amino acid sequence of SEQ ID NO: 902 as CDR1, the amino acid sequence of SEQ ID NO: 904 as CDR2, and the amino acid sequence of SEQ ID NO: 906 as CDR3;

(338) an antibody that comprises an L chain having the amino acid sequence of SEQ ID NO: 908 as CDR1, the amino acid sequence of SEQ ID NO: 910 as CDR2, and the amino acid sequence of SEQ ID NO: 912 as CDR3;

(339) an antibody that comprises the H chain of (337) and the L chain of (338);

(340) an antibody that comprises an H chain having the amino acid sequence of SEQ ID NO: 2514 as VH;

(341) an antibody that comprises an L chain having the amino acid sequence of SEQ ID NO: 2516 as VL;

(342) an antibody that comprises the H chain of (340) and the L chain of (341);

(343) an antibody that comprises an H chain having the amino acid sequence of SEQ ID NO: 918 as CDR1, the amino acid sequence of SEQ ID NO: 920 as CDR2, and the amino acid sequence of SEQ ID NO: 922 as CDR3;

(344) an antibody that comprises an L chain having the amino acid sequence of SEQ ID NO: 924 as CDR1, the amino acid sequence of SEQ ID NO: 926 as CDR2, and the amino acid sequence of SEQ ID NO: 928 as CDR3;

(345) an antibody that comprises the H chain of (343) and the L chain of (344);

(346) an antibody that comprises an H chain having the amino acid sequence of SEQ ID NO: 2518 as VH;

(347) an antibody that comprises an L chain having the amino acid sequence of SEQ ID NO: 2520 as VL;

(348) an antibody that comprises the H chain of (346) and the L chain of (347);

(349) an antibody that comprises an H chain having the amino acid sequence of SEQ ID NO: 934 as CDR1, the amino acid sequence of SEQ ID NO: 936 as CDR2, and the amino acid sequence of SEQ ID NO: 938 as CDR3;

(350) an antibody that comprises an L chain having the amino acid sequence of SEQ ID NO: 940 as CDR1, the amino acid sequence of SEQ ID NO: 942 as CDR2, and the amino acid sequence of SEQ ID NO: 944 as CDR3;

(351) an antibody that comprises the H chain of (349) and the L chain of (350);

(352) an antibody that comprises an H chain having the amino acid sequence of SEQ ID NO: 2522 as VH;

(353) an antibody that comprises an L chain having the amino acid sequence of SEQ ID NO: 2524 as VL;

(354) an antibody that comprises the H chain of (352) and the L chain of (353);

(355) an antibody that comprises an H chain having the amino acid sequence of SEQ ID NO: 950 as CDR1, the amino acid sequence of SEQ ID NO: 952 as CDR2, and the amino acid sequence of SEQ ID NO: 954 as CDR3;

(356) an antibody that comprises an L chain having the amino acid sequence of SEQ ID NO: 956 as CDR1, the amino acid sequence of SEQ ID NO: 958 as CDR2, and the amino acid sequence of SEQ ID NO: 960 as CDR3;

(357) an antibody that comprises the H chain of (355) and the L chain of (356);

(358) an antibody that comprises an H chain having the amino acid sequence of SEQ ID NO: 2526 as VH;

(359) an antibody that comprises an L chain having the amino acid sequence of SEQ ID NO: 2528 as VL;

(360) an antibody that comprises the H chain of (358) and the L chain of (359);

(361) an antibody that comprises an H chain having the amino acid sequence of SEQ ID NO: 966 as CDR1, the amino acid sequence of SEQ ID NO: 968 as CDR2, and the amino acid sequence of SEQ ID NO: 970 as CDR3;

(362) an antibody that comprises an L chain having the amino acid sequence of SEQ ID NO: 972 as CDR1, the amino acid sequence of SEQ ID NO: 974 as CDR2, and the amino acid sequence of SEQ ID NO: 976 as CDR3;

(363) an antibody that comprises the H chain of (361) and the L chain of (362);

(364) an antibody that comprises an H chain having the amino acid sequence of SEQ ID NO: 2530 as VH;

(365) an antibody that comprises an L chain having the amino acid sequence of SEQ ID NO: 2532 as VL;

(366) an antibody that comprises the H chain of (364) and the L chain of (365);

(367) an antibody that comprises an H chain having the amino acid sequence of SEQ ID NO: 982 as CDR1, the amino acid sequence of SEQ ID NO: 984 as CDR2, and the amino acid sequence of SEQ ID NO: 986 as CDR3;

(368) an antibody that comprises an L chain having the amino acid sequence of SEQ ID NO: 988 as CDR1, the amino acid sequence of SEQ ID NO: 990 as CDR2, and the amino acid sequence of SEQ ID NO: 992 as CDR3;

(369) an antibody that comprises the H chain of (367) and the L chain of (368);

(370) an antibody that comprises an H chain having the amino acid sequence of SEQ ID NO: 2534 as VH;

(371) an antibody that comprises an L chain having the amino acid sequence of SEQ ID NO: 2536 as VL;

(372) an antibody that comprises the H chain of (370) and the L chain of (371);

(373) an antibody that comprises an H chain having the amino acid sequence of SEQ ID NO: 998 as CDR1, the amino acid sequence of SEQ ID NO: 1000 as CDR2, and the amino acid sequence of SEQ ID NO: 1002 as CDR3;

(374) an antibody that comprises an L chain having the amino acid sequence of SEQ ID NO: 1004 as CDR1, the amino acid sequence of SEQ ID NO: 1006 as CDR2, and the amino acid sequence of SEQ ID NO: 1008 as CDR3;

(375) an antibody that comprises the H chain of (373) and the L chain of (374);

(376) an antibody that comprises an H chain having the amino acid sequence of SEQ ID NO: 2538 as VH;

(377) an antibody that comprises an L chain having the amino acid sequence of SEQ ID NO: 2540 as VL;

(378) an antibody that comprises the H chain of (376) and the L chain of (377);

(379) an antibody that comprises an H chain having the amino acid sequence of SEQ ID NO: 1014 as CDR1, the amino acid sequence of SEQ ID NO: 1016 as CDR2, and the amino acid sequence of SEQ ID NO: 1018 as CDR3;

(380) an antibody that comprises an L chain having the amino acid sequence of SEQ ID NO: 1020 as CDR1, the amino acid sequence of SEQ ID NO: 1022 as CDR2, and the amino acid sequence of SEQ ID NO: 1024 as CDR3;

(381) an antibody that comprises the H chain of (379) and the L chain of (380);

(382) an antibody that comprises an H chain having the amino acid sequence of SEQ ID NO: 2542 as VH;

(383) an antibody that comprises an L chain having the amino acid sequence of SEQ ID NO: 2544 as VL;

(384) an antibody that comprises the H chain of (382) and the L chain of (383);

(385) an antibody that comprises an H chain having the amino acid sequence of SEQ ID NO: 1030 as CDR1, the amino acid sequence of SEQ ID NO: 1032 as CDR2, and the amino acid sequence of SEQ ID NO: 1034 as CDR3;

(386) an antibody that comprises an L chain having the amino acid sequence of SEQ ID NO: 1036 as CDR1, the amino acid sequence of SEQ ID NO: 1038 as CDR2, and the amino acid sequence of SEQ ID NO: 1040 as CDR3;

(387) an antibody that comprises the H chain of (385) and the L chain of (386);

(388) an antibody that comprises an H chain having the amino acid sequence of SEQ ID NO: 2546 as VH;

(389) an antibody that comprises an L chain having the amino acid sequence of SEQ ID NO: 2548 as VL;

(390) an antibody that comprises the H chain of (388) and the L chain of (389);

(391) an antibody that comprises an H chain having the amino acid sequence of SEQ ID NO: 1046 as CDR1, the amino acid sequence of SEQ ID NO: 1048 as CDR2, and the amino acid sequence of SEQ ID NO: 1050 as CDR3;

(392) an antibody that comprises an L chain having the amino acid sequence of SEQ ID NO: 1052 as CDR1, the amino acid sequence of SEQ ID NO: 1054 as CDR2, and the amino acid sequence of SEQ ID NO: 1056 as CDR3;

(393) an antibody that comprises the H chain of (391) and the L chain of (392);

(394) an antibody that comprises an H chain having the amino acid sequence of SEQ ID NO: 2550 as VH;

(395) an antibody that comprises an L chain having the amino acid sequence of SEQ ID NO: 2552 as VL;

(396) an antibody that comprises the H chain of (394) and the L chain of (395);

(397) an antibody that comprises an H chain having the amino acid sequence of SEQ ID NO: 1062 as CDR1, the amino acid sequence of SEQ ID NO: 1064 as CDR2, and the amino acid sequence of SEQ ID NO: 1066 as CDR3;

(398) an antibody that comprises an L chain having the amino acid sequence of SEQ ID NO: 1068 as CDR1, the amino acid sequence of SEQ ID NO: 1070 as CDR2, and the amino acid sequence of SEQ ID NO: 1072 as CDR3;

(399) an antibody that comprises the H chain of (397) and the L chain of (398);

(400) an antibody that comprises an H chain having the amino acid sequence of SEQ ID NO: 2554 as VH;

(401) an antibody that comprises an L chain having the amino acid sequence of SEQ ID NO: 2556 as VL;

(402) an antibody that comprises the H chain of (400) and the L chain of (401);

(403) an antibody that comprises an H chain having the amino acid sequence of SEQ ID NO: 1078 as CDR1, the amino acid sequence of SEQ ID NO: 1080 as CDR2, and the amino acid sequence of SEQ ID NO: 1082 as CDR3;

(404) an antibody that comprises an L chain having the amino acid sequence of SEQ ID NO: 1084 as CDR1, the amino acid sequence of SEQ ID NO: 1086 as CDR2, and the amino acid sequence of SEQ ID NO: 1088 as CDR3;

(405) an antibody that comprises the H chain of (403) and the L chain of (404);

(406) an antibody that comprises an H chain having the amino acid sequence of SEQ ID NO: 2558 as VH;

(407) an antibody that comprises an L chain having the amino acid sequence of SEQ ID NO: 2560 as VL;

(408) an antibody that comprises the H chain of (406) and the L chain of (407);

(409) an antibody that comprises an H chain having the amino acid sequence of SEQ ID NO: 1094 as CDR1, the amino acid sequence of SEQ ID NO: 1096 as CDR2, and the amino acid sequence of SEQ ID NO: 1098 as CDR3;

(410) an antibody that comprises an L chain having the amino acid sequence of SEQ ID NO: 1100 as CDR1, the amino acid sequence of SEQ ID NO: 1102 as CDR2, and the amino acid sequence of SEQ ID NO: 1104 as CDR3;

(411) an antibody that comprises the H chain of (409) and the L chain of (410);

(412) an antibody that comprises an H chain having the amino acid sequence of SEQ ID NO: 2562 as VH;

(413) an antibody that comprises an L chain having the amino acid sequence of SEQ ID NO: 2564 as VL;

(414) an antibody that comprises the H chain of (412) and the L chain of (413);

(415) an antibody that comprises an H chain having the amino acid sequence of SEQ ID NO: 1110 as CDR1, the amino acid sequence of SEQ ID NO: 1112 as CDR2, and the amino acid sequence of SEQ ID NO: 1114 as CDR3;

(416) an antibody that comprises an L chain having the amino acid sequence of SEQ ID NO: 1116 as CDR1, the amino acid sequence of SEQ ID NO: 1118 as CDR2, and the amino acid sequence of SEQ ID NO: 1120 as CDR3;

(417) an antibody that comprises the H chain of (415) and the L chain of (416);

(418) an antibody that comprises an H chain having the amino acid sequence of SEQ ID NO: 2566 as VH;

(419) an antibody that comprises an L chain having the amino acid sequence of SEQ ID NO: 2568 as VL;

(420) an antibody that comprises the H chain of (418) and the L chain of (419);

(421) an antibody that comprises an H chain having the amino acid sequence of SEQ ID NO: 1126 as CDR1, the amino acid sequence of SEQ ID NO: 1128 as CDR2, and the amino acid sequence of SEQ ID NO: 1130 as CDR3;

(422) an antibody that comprises an L chain having the amino acid sequence of SEQ ID NO: 1132 as CDR1, the amino acid sequence of SEQ ID NO: 1134 as CDR2, and the amino acid sequence of SEQ ID NO: 1136 as CDR3;

(423) an antibody that comprises the H chain of (421) and the L chain of (422);

(424) an antibody that comprises an H chain having the amino acid sequence of SEQ ID NO: 2570 as VH;

(425) an antibody that comprises an L chain having the amino acid sequence of SEQ ID NO: 2572 as VL;

(426) an antibody that comprises the H chain of (424) and the L chain of (425);

(427) an antibody that comprises an H chain having the amino acid sequence of SEQ ID NO: 1142 as CDR1, the amino acid sequence of SEQ ID NO: 1144 as CDR2, and the amino acid sequence of SEQ ID NO: 1146 as CDR3;

(428) an antibody that comprises an L chain having the amino acid sequence of SEQ ID NO: 1148 as CDR1, the amino acid sequence of SEQ ID NO: 1150 as CDR2, and the amino acid sequence of SEQ ID NO: 1152 as CDR3;

(429) an antibody that comprises the H chain of (427) and the L chain of (428);

(430) an antibody that comprises an H chain having the amino acid sequence of SEQ ID NO: 2574 as VH;

(431) an antibody that comprises an L chain having the amino acid sequence of SEQ ID NO: 2576 as VL;

(432) an antibody that comprises the H chain of (430) and the L chain of (431);

(433) an antibody that comprises an H chain having the amino acid sequence of SEQ ID NO: 1158 as CDR1, the amino acid sequence of SEQ ID NO: 1160 as CDR2, and the amino acid sequence of SEQ ID NO: 1162 as CDR3;

(434) an antibody that comprises an L chain having the amino acid sequence of SEQ ID NO: 1164 as CDR1, the amino acid sequence of SEQ ID NO: 1166 as CDR2, and the amino acid sequence of SEQ ID NO: 1168 as CDR3;

(435) an antibody that comprises the H chain of (433) and the L chain of (434);

(436) an antibody that comprises an H chain having the amino acid sequence of SEQ ID NO: 2578 as VH;

(437) an antibody that comprises an L chain having the amino acid sequence of SEQ ID NO: 2580 as VL;

(438) an antibody that comprises the H chain of (436) and the L chain of (437);

(439) an antibody that comprises an H chain having the amino acid sequence of SEQ ID NO: 1174 as CDR1, the amino acid sequence of SEQ ID NO: 1176 as CDR2, and the amino acid sequence of SEQ ID NO: 1178 as CDR3;

(440) an antibody that comprises an L chain having the amino acid sequence of SEQ ID NO: 1180 as CDR1, the amino acid sequence of SEQ ID NO: 1182 as CDR2, and the amino acid sequence of SEQ ID NO: 1184 as CDR3;

(441) an antibody that comprises the H chain of (439) and the L chain of (440);

(442) an antibody that comprises an H chain having the amino acid sequence of SEQ ID NO: 2582 as VH;

(443) an antibody that comprises an L chain having the amino acid sequence of SEQ ID NO: 2584 as VL;

(444) an antibody that comprises the H chain of (442) and the L chain of (443);

(445) an antibody that comprises an H chain having the amino acid sequence of SEQ ID NO: 1190 as CDR1, the amino acid sequence of SEQ ID NO: 1192 as CDR2, and the amino acid sequence of SEQ ID NO: 1194 as CDR3;

(446) an antibody that comprises an L chain having the amino acid sequence of SEQ ID NO: 1196 as CDR1, the amino acid sequence of SEQ ID NO: 1198 as CDR2, and the amino acid sequence of SEQ ID NO: 1200 as CDR3;

(447) an antibody that comprises the H chain of (445) and the L chain of (446);

(448) an antibody that comprises an H chain having the amino acid sequence of SEQ ID NO: 2586 as VH;

(449) an antibody that comprises an L chain having the amino acid sequence of SEQ ID NO: 2588 as VL;

(450) an antibody that comprises the H chain of (448) and the L chain of (449);

(451) an antibody that comprises an H chain having the amino acid sequence of SEQ ID NO: 1206 as CDR1, the amino acid sequence of SEQ ID NO: 1208 as CDR2, and the amino acid sequence of SEQ ID NO: 1210 as CDR3;

(452) an antibody that comprises an L chain having the amino acid sequence of SEQ ID NO: 1212 as CDR1, the amino acid sequence of SEQ ID NO: 1214 as CDR2, and the amino acid sequence of SEQ ID NO: 1216 as CDR3;

(453) an antibody that comprises the H chain of (451) and the L chain of (452);

(454) an antibody that comprises an H chain having the amino acid sequence of SEQ ID NO: 2590 as VH;

(455) an antibody that comprises an L chain having the amino acid sequence of SEQ ID NO: 2592 as VL;

(456) an antibody that comprises the H chain of (454) and the L chain of (455);

(457) an antibody that comprises an H chain having the amino acid sequence of SEQ ID NO: 1222 as CDR1, the amino acid sequence of SEQ ID NO: 1224 as CDR2, and the amino acid sequence of SEQ ID NO: 1226 as CDR3;

(458) an antibody that comprises an L chain having the amino acid sequence of SEQ ID NO: 1228 as CDR1, the amino acid sequence of SEQ ID NO: 1230 as CDR2, and the amino acid sequence of SEQ ID NO: 1232 as CDR3;

(459) an antibody that comprises the H chain of (457) and the L chain of (458);

(460) an antibody that comprises an H chain having the amino acid sequence of SEQ ID NO: 2594 as VH;

(461) an antibody that comprises an L chain having the amino acid sequence of SEQ ID NO: 2596 as VL;

(462) an antibody that comprises the H chain of (460) and the L chain of (461);

(463) an antibody that comprises an H chain having the amino acid sequence of SEQ ID NO: 1238 as CDR1, the amino acid sequence of SEQ ID NO: 1240 as CDR2, and the amino acid sequence of SEQ ID NO: 1242 as CDR3;

(464) an antibody that comprises an L chain having the amino acid sequence of SEQ ID NO: 1244 as CDR1, the amino acid sequence of SEQ ID NO: 1246 as CDR2, and the amino acid sequence of SEQ ID NO: 1248 as CDR3;

(465) an antibody that comprises the H chain of (463) and the L chain of (464);

(466) an antibody that comprises an H chain having the amino acid sequence of SEQ ID NO: 2598 as VH;

(467) an antibody that comprises an L chain having the amino acid sequence of SEQ ID NO: 2600 as VL;

(468) an antibody that comprises the H chain of (466) and the L chain of (467);

(469) an antibody that comprises an H chain having the amino acid sequence of SEQ ID NO: 1254 as CDR1, the amino acid sequence of SEQ ID NO: 1256 as CDR2, and the amino acid sequence of SEQ ID NO: 1258 as CDR3;

(470) an antibody that comprises an L chain having the amino acid sequence of SEQ ID NO: 1260 as CDR1, the amino acid sequence of SEQ ID NO: 1262 as CDR2, and the amino acid sequence of SEQ ID NO: 1264 as CDR3;

(471) an antibody that comprises the H chain of (469) and the L chain of (470);

(472) an antibody that comprises an H chain having the amino acid sequence of SEQ ID NO: 2602 as VH;

(473) an antibody that comprises an L chain having the amino acid sequence of SEQ ID NO: 2604 as VL;

(474) an antibody that comprises the H chain of (472) and the L chain of (473);

(475) an antibody that comprises an H chain having the amino acid sequence of SEQ ID NO: 1270 as CDR1, the amino acid sequence of SEQ ID NO: 1272 as CDR2, and the amino acid sequence of SEQ ID NO: 1274 as CDR3;

(476) an antibody that comprises an L chain having the amino acid sequence of SEQ ID NO: 1276 as CDR1, the amino acid sequence of SEQ ID NO: 1278 as CDR2, and the amino acid sequence of SEQ ID NO: 1280 as CDR3;

(477) an antibody that comprises the H chain of (475) and the L chain of (476);

(478) an antibody that comprises an H chain having the amino acid sequence of SEQ ID NO: 2606 as VH;

(479) an antibody that comprises an L chain having the amino acid sequence of SEQ ID NO: 2608 as VL;

(480) an antibody that comprises the H chain of (478) and the L chain of (479);

(481) an antibody that comprises an H chain having the amino acid sequence of SEQ ID NO: 1286 as CDR1, the amino acid sequence of SEQ ID NO: 1288 as CDR2, and the amino acid sequence of SEQ ID NO: 1290 as CDR3;

(482) an antibody that comprises an L chain having the amino acid sequence of SEQ ID NO: 1292 as CDR1, the amino acid sequence of SEQ ID NO: 1294 as CDR2, and the amino acid sequence of SEQ ID NO: 1296 as CDR3;

(483) an antibody that comprises the H chain of (481) and the L chain of (482);

(484) an antibody that comprises an H chain having the amino acid sequence of SEQ ID NO: 2610 as VH;

(485) an antibody that comprises an L chain having the amino acid sequence of SEQ ID NO: 2612 as VL;

(486) an antibody that comprises the H chain of (484) and the L chain of (485);

(487) an antibody that comprises an H chain having the amino acid sequence of SEQ ID NO: 1302 as CDR1, the amino acid sequence of SEQ ID NO: 1304 as CDR2, and the amino acid sequence of SEQ ID NO: 1306 as CDR3;

(488) an antibody that comprises an L chain having the amino acid sequence of SEQ ID NO: 1308 as CDR1, the amino acid sequence of SEQ ID NO: 1310 as CDR2, and the amino acid sequence of SEQ ID NO: 1312 as CDR3;

(489) an antibody that comprises the H chain of (487) and the L chain of (488);

(490) an antibody that comprises an H chain having the amino acid sequence of SEQ ID NO: 2614 as VH;

(491) an antibody that comprises an L chain having the amino acid sequence of SEQ ID NO: 2616 as VL;

(492) an antibody that comprises the H chain of (490) and the L chain of (491);

(493) an antibody that comprises an H chain having the amino acid sequence of SEQ ID NO: 1318 as CDR1, the amino acid sequence of SEQ ID NO: 1320 as CDR2, and the amino acid sequence of SEQ ID NO: 1322 as CDR3;

(494) an antibody that comprises an L chain having the amino acid sequence of SEQ ID NO: 1324 as CDR1, the amino acid sequence of SEQ ID NO: 1326 as CDR2, and the amino acid sequence of SEQ ID NO: 1328 as CDR3;

(495) an antibody that comprises the H chain of (493) and the L chain of (494);

(496) an antibody that comprises an H chain having the amino acid sequence of SEQ ID NO: 2618 as VH;

(497) an antibody that comprises an L chain having the amino acid sequence of SEQ ID NO: 2620 as VL;

(498) an antibody that comprises the H chain of (496) and the L chain of (497);

(499) an antibody that comprises an H chain having the amino acid sequence of SEQ ID NO: 1334 as CDR1, the amino acid sequence of SEQ ID NO: 1336 as CDR2, and the amino acid sequence of SEQ ID NO: 1338 as CDR3;

(500) an antibody that comprises an L chain having the amino acid sequence of SEQ ID NO: 1340 as CDR1, the amino acid sequence of SEQ ID NO: 1342 as CDR2, and the amino acid sequence of SEQ ID NO: 1344 as CDR3;

(501) an antibody that comprises the H chain of (499) and the L chain of (500);

(502) an antibody that comprises an H chain having the amino acid sequence of SEQ ID NO: 2622 as VH;

(503) an antibody that comprises an L chain having the amino acid sequence of SEQ ID NO: 2624 as VL;

(504) an antibody that comprises the H chain of (502) and the L chain of (503);

(505) an antibody that comprises an H chain having the amino acid sequence of SEQ ID NO: 1350 as CDR1, the amino acid sequence of SEQ ID NO: 1352 as CDR2, and the amino acid sequence of SEQ ID NO: 1354 as CDR3;

(506) an antibody that comprises an L chain having the amino acid sequence of SEQ ID NO: 1356 as CDR1, the amino acid sequence of SEQ ID NO: 1358 as CDR2, and the amino acid sequence of SEQ ID NO: 1360 as CDR3;

(507) an antibody that comprises the H chain of (505) and the L chain of (506);

(508) an antibody that comprises an H chain having the amino acid sequence of SEQ ID NO: 2626 as VH;

(509) an antibody that comprises an L chain having the amino acid sequence of SEQ ID NO: 2628 as VL;

(510) an antibody that comprises the H chain of (508) and the L chain of (509);

(511) an antibody that comprises an H chain having the amino acid sequence of SEQ ID NO: 1366 as CDR1, the amino acid sequence of SEQ ID NO: 1368 as CDR2, and the amino acid sequence of SEQ ID NO: 1370 as CDR3;

(512) an antibody that comprises an L chain having the amino acid sequence of SEQ ID NO: 1372 as CDR1, the amino acid sequence of SEQ ID NO: 1374 as CDR2, and the amino acid sequence of SEQ ID NO: 1376 as CDR3;

(513) an antibody that comprises the H chain of (511) and the L chain of (512);

(514) an antibody that comprises an H chain having the amino acid sequence of SEQ ID NO: 2630 as VH;

(515) an antibody that comprises an L chain having the amino acid sequence of SEQ ID NO: 2632 as VL;

(516) an antibody that comprises the H chain of (514) and the L chain of (515);

(517) an antibody that comprises an H chain having the amino acid sequence of SEQ ID NO: 1382 as CDR1, the amino acid sequence of SEQ ID NO: 1384 as CDR2, and the amino acid sequence of SEQ ID NO: 1386 as CDR3;

(518) an antibody that comprises an L chain having the amino acid sequence of SEQ ID NO: 1388 as CDR1, the amino acid sequence of SEQ ID NO: 1390 as CDR2, and the amino acid sequence of SEQ ID NO: 1392 as CDR3;

(519) an antibody that comprises the H chain of (517) and the L chain of (518);

(520) an antibody that comprises an H chain having the amino acid sequence of SEQ ID NO: 2634 as VH;

(521) an antibody that comprises an L chain having the amino acid sequence of SEQ ID NO: 2636 as VL;

(522) an antibody that comprises the H chain of (520) and the L chain of (521);

(523) an antibody that comprises an H chain having the amino acid sequence of SEQ ID NO: 1398 as CDR1, the amino acid sequence of SEQ ID NO: 1400 as CDR2, and the amino acid sequence of SEQ ID NO: 1402 as CDR3;

(524) an antibody that comprises an L chain having the amino acid sequence of SEQ ID NO: 1404 as CDR1, the amino acid sequence of SEQ ID NO: 1406 as CDR2, and the amino acid sequence of SEQ ID NO: 1408 as CDR3;

(525) an antibody that comprises the H chain of (523) and the L chain of (524);

(526) an antibody that comprises an H chain having the amino acid sequence of SEQ ID NO: 2638 as VH;

(527) an antibody that comprises an L chain having the amino acid sequence of SEQ ID NO: 2640 as VL;

(528) an antibody that comprises the H chain of (526) and the L chain of (527);

(529) an antibody that comprises an H chain having the amino acid sequence of SEQ ID NO: 1414 as CDR1, the amino acid sequence of SEQ ID NO: 1416 as CDR2, and the amino acid sequence of SEQ ID NO: 1418 as CDR3;

(530) an antibody that comprises an L chain having the amino acid sequence of SEQ ID NO: 1420 as CDR1, the amino acid sequence of SEQ ID NO: 1422 as CDR2, and the amino acid sequence of SEQ ID NO: 1424 as CDR3;

(531) an antibody that comprises the H chain of (529) and the L chain of (530);

(532) an antibody that comprises an H chain having the amino acid sequence of SEQ ID NO: 2642 as VH;

(533) an antibody that comprises an L chain having the amino acid sequence of SEQ ID NO: 2644 as VL;

(534) an antibody that comprises the H chain of (532) and the L chain of (533);

(535) an antibody that comprises an H chain having the amino acid sequence of SEQ ID NO: 1430 as CDR1, the amino acid sequence of SEQ ID NO: 1432 as CDR2, and the amino acid sequence of SEQ ID NO: 1434 as CDR3;

(536) an antibody that comprises an L chain having the amino acid sequence of SEQ ID NO: 1436 as CDR1, the amino acid sequence of SEQ ID NO: 1438 as CDR2, and the amino acid sequence of SEQ ID NO: 1440 as CDR3;

(537) an antibody that comprises the H chain of (535) and the L chain of (536);

(538) an antibody that comprises an H chain having the amino acid sequence of SEQ ID NO: 2646 as VH;

(539) an antibody that comprises an L chain having the amino acid sequence of SEQ ID NO: 2648 as VL;

(540) an antibody that comprises the H chain of (538) and the L chain of (539);

(541) an antibody that comprises an H chain having the amino acid sequence of SEQ ID NO: 1446 as CDR1, the amino acid sequence of SEQ ID NO: 1448 as CDR2, and the amino acid sequence of SEQ ID NO: 1450 as CDR3;

(542) an antibody that comprises an L chain having the amino acid sequence of SEQ ID NO: 1452 as CDR1, the amino acid sequence of SEQ ID NO: 1454 as CDR2, and the amino acid sequence of SEQ ID NO: 1456 as CDR3;

(543) an antibody that comprises the H chain of (541) and the L chain of (542);

(544) an antibody that comprises an H chain having the amino acid sequence of SEQ ID NO: 2650 as VH;

(545) an antibody that comprises an L chain having the amino acid sequence of SEQ ID NO: 2652 as VL;

(546) an antibody that comprises the H chain of (544) and the L chain of (545);

(547) an antibody that comprises an H chain having the amino acid sequence of SEQ ID NO: 1462 as CDR1, the amino acid sequence of SEQ ID NO: 1464 as CDR2, and the amino acid sequence of SEQ ID NO: 1466 as CDR3;

(548) an antibody that comprises an L chain having the amino acid sequence of SEQ ID NO: 1468 as CDR1, the amino acid sequence of SEQ ID NO: 1470 as CDR2, and the amino acid sequence of SEQ ID NO: 1472 as CDR3;

(549) an antibody that comprises the H chain of (547) and the L chain of (548);

(550) an antibody that comprises an H chain having the amino acid sequence of SEQ ID NO: 2654 as VH;

(551) an antibody that comprises an L chain having the amino acid sequence of SEQ ID NO: 2656 as VL;

(552) an antibody that comprises the H chain of (550) and the L chain of (551);

(553) an antibody that comprises an H chain having the amino acid sequence of SEQ ID NO: 1478 as CDR1, the amino acid sequence of SEQ ID NO: 1480 as CDR2, and the amino acid sequence of SEQ ID NO: 1482 as CDR3;

(554) an antibody that comprises an L chain having the amino acid sequence of SEQ ID NO: 1484 as CDR1, the amino acid sequence of SEQ ID NO: 1486 as CDR2, and the amino acid sequence of SEQ ID NO: 1488 as CDR3;

(555) an antibody that comprises the H chain of (553) and the L chain of (554);

(556) an antibody that comprises an H chain having the amino acid sequence of SEQ ID NO: 2658 as VH;

(557) an antibody that comprises an L chain having the amino acid sequence of SEQ ID NO: 2660 as VL;

(558) an antibody that comprises the H chain of (556) and the L chain of (557);

(559) an antibody that comprises an H chain having the amino acid sequence of SEQ ID NO: 1494 as CDR1, the amino acid sequence of SEQ ID NO: 1496 as CDR2, and the amino acid sequence of SEQ ID NO: 1498 as CDR3;

(560) an antibody that comprises an L chain having the amino acid sequence of SEQ ID NO: 1500 as CDR1, the amino acid sequence of SEQ ID NO: 1502 as CDR2, and the amino acid sequence of SEQ ID NO: 1504 as CDR3;

(561) an antibody that comprises the H chain of (559) and the L chain of (560);

(562) an antibody that comprises an H chain having the amino acid sequence of SEQ ID NO: 2662 as VH;

(563) an antibody that comprises an L chain having the amino acid sequence of SEQ ID NO: 2664 as VL;

(564) an antibody that comprises the H chain of (562) and the L chain of (563);

(565) an antibody that comprises an H chain having the amino acid sequence of SEQ ID NO: 1510 as CDR1, the amino acid sequence of SEQ ID NO: 1512 as CDR2, and the amino acid sequence of SEQ ID NO: 1514 as CDR3;

(566) an antibody that comprises an L chain having the amino acid sequence of SEQ ID NO: 1516 as CDR1, the amino acid sequence of SEQ ID NO: 1518 as CDR2, and the amino acid sequence of SEQ ID NO: 1520 as CDR3;

(567) an antibody that comprises the H chain of (565) and the L chain of (566);

(568) an antibody that comprises an H chain having the amino acid sequence of SEQ ID NO: 2666 as VH;

(569) an antibody that comprises an L chain having the amino acid sequence of SEQ ID NO: 2668 as VL;

(570) an antibody that comprises the H chain of (568) and the L chain of (569);

(571) an antibody that comprises an H chain having the amino acid sequence of SEQ ID NO: 1526 as CDR1, the amino acid sequence of SEQ ID NO: 1528 as CDR2, and the amino acid sequence of SEQ ID NO: 1530 as CDR3;

(572) an antibody that comprises an L chain having the amino acid sequence of SEQ ID NO: 1532 as CDR1, the amino acid sequence of SEQ ID NO: 1534 as CDR2, and the amino acid sequence of SEQ ID NO: 1536 as CDR3;

(573) an antibody that comprises the H chain of (571) and the L chain of (572);

(574) an antibody that comprises an H chain having the amino acid sequence of SEQ ID NO: 2670 as VH;

(575) an antibody that comprises an L chain having the amino acid sequence of SEQ ID NO: 2672 as VL;

(576) an antibody that comprises the H chain of (574) and the L chain of (575);

(577) an antibody that comprises an H chain having the amino acid sequence of SEQ ID NO: 1542 as CDR1, the amino acid sequence of SEQ ID NO: 1544 as CDR2, and the amino acid sequence of SEQ ID NO: 1546 as CDR3;

(578) an antibody that comprises an L chain having the amino acid sequence of SEQ ID NO: 1548 as CDR1, the amino acid sequence of SEQ ID NO: 1550 as CDR2, and the amino acid sequence of SEQ ID NO: 1552 as CDR3;

(579) an antibody that comprises the H chain of (577) and the L chain of (578);

(580) an antibody that comprises an H chain having the amino acid sequence of SEQ ID NO: 2674 as VH;

(581) an antibody that comprises an L chain having the amino acid sequence of SEQ ID NO: 2676 as VL;

(582) an antibody that comprises the H chain of (580) and the L chain of (581);

(583) an antibody that comprises an H chain having the amino acid sequence of SEQ ID NO: 1558 as CDR1, the amino acid sequence of SEQ ID NO: 1560 as CDR2, and the amino acid sequence of SEQ ID NO: 1562 as CDR3;

(584) an antibody that comprises an L chain having the amino acid sequence of SEQ ID NO: 1564 as CDR1, the amino acid sequence of SEQ ID NO: 1566 as CDR2, and the amino acid sequence of SEQ ID NO: 1568 as CDR3;

(585) an antibody that comprises the H chain of (583) and the L chain of (584);

(586) an antibody that comprises an H chain having the amino acid sequence of SEQ ID NO: 2678 as VH;

(587) an antibody that comprises an L chain having the amino acid sequence of SEQ ID NO: 2680 as VL;

(588) an antibody that comprises the H chain of (586) and the L chain of (587);

(589) an antibody that comprises an H chain having the amino acid sequence of SEQ ID NO: 1574 as CDR1, the amino acid sequence of SEQ ID NO: 1576 as CDR2, and the amino acid sequence of SEQ ID NO: 1578 as CDR3;

(590) an antibody that comprises an L chain having the amino acid sequence of SEQ ID NO: 1580 as CDR1, the amino acid sequence of SEQ ID NO: 1582 as CDR2, and the amino acid sequence of SEQ ID NO: 1584 as CDR3;

(591) an antibody that comprises the H chain of (589) and the L chain of (590);

(592) an antibody that comprises an H chain having the amino acid sequence of SEQ ID NO: 2682 as VH;

(593) an antibody that comprises an L chain having the amino acid sequence of SEQ ID NO: 2684 as VL;

(594) an antibody that comprises the H chain of (592) and the L chain of (593);

(595) an antibody that comprises an H chain having the amino acid sequence of SEQ ID NO: 1590 as CDR1, the amino acid sequence of SEQ ID NO: 1592 as CDR2, and the amino acid sequence of SEQ ID NO: 1594 as CDR3;

(596) an antibody that comprises an L chain having the amino acid sequence of SEQ ID NO: 1596 as CDR1, the amino acid sequence of SEQ ID NO: 1598 as CDR2, and the amino acid sequence of SEQ ID NO: 1600 as CDR3;

(597) an antibody that comprises the H chain of (595) and the L chain of (596);

(598) an antibody that comprises an H chain having the amino acid sequence of SEQ ID NO: 2686 as VH;

(599) an antibody that comprises an L chain having the amino acid sequence of SEQ ID NO: 2688 as VL;

(600) an antibody that comprises the H chain of (598) and the L chain of (599);

(601) an antibody that comprises an H chain having the amino acid sequence of SEQ ID NO: 1606 as CDR1, the amino acid sequence of SEQ ID NO: 1608 as CDR2, and the amino acid sequence of SEQ ID NO: 1610 as CDR3;

(602) an antibody that comprises an L chain having the amino acid sequence of SEQ ID NO: 1612 as CDR1, the amino acid sequence of SEQ ID NO: 1614 as CDR2, and the amino acid sequence of SEQ ID NO: 1616 as CDR3;

(603) an antibody that comprises the H chain of (601) and the L chain of (602);

(604) an antibody that comprises an H chain having the amino acid sequence of SEQ ID NO: 2690 as VH;

(605) an antibody that comprises an L chain having the amino acid sequence of SEQ ID NO: 2692 as VL;

(606) an antibody that comprises the H chain of (604) and the L chain of (605);

(607) an antibody that comprises an H chain having the amino acid sequence of SEQ ID NO: 1622 as CDR1, the amino acid sequence of SEQ ID NO: 1624 as CDR2, and the amino acid sequence of SEQ ID NO: 1626 as CDR3;

(608) an antibody that comprises an L chain having the amino acid sequence of SEQ ID NO: 1628 as CDR1, the amino acid sequence of SEQ ID NO: 1630 as CDR2, and the amino acid sequence of SEQ ID NO: 1632 as CDR3;

(609) an antibody that comprises the H chain of (607) and the L chain of (608);

(610) an antibody that comprises an H chain having the amino acid sequence of SEQ ID NO: 2694 as VH;

(611) an antibody that comprises an L chain having the amino acid sequence of SEQ ID NO: 2696 as VL;

(612) an antibody that comprises the H chain of (610) and the L chain of (611);

(613) an antibody that comprises an H chain having the amino acid sequence of SEQ ID NO: 1638 as CDR1, the amino acid sequence of SEQ ID NO: 1640 as CDR2, and the amino acid sequence of SEQ ID NO: 1642 as CDR3;

(614) an antibody that comprises an L chain having the amino acid sequence of SEQ ID NO: 1644 as CDR1, the amino acid sequence of SEQ ID NO: 1646 as CDR2, and the amino acid sequence of SEQ ID NO: 1648 as CDR3;

(615) an antibody that comprises the H chain of (613) and the L chain of (614);

(616) an antibody that comprises an H chain having the amino acid sequence of SEQ ID NO: 2698 as VH;

(617) an antibody that comprises an L chain having the amino acid sequence of SEQ ID NO: 2700 as VL;

(618) an antibody that comprises the H chain of (616) and the L chain of (617);

(619) an antibody that comprises an H chain having the amino acid sequence of SEQ ID NO: 1654 as CDR1, the amino acid sequence of SEQ ID NO: 1656 as CDR2, and the amino acid sequence of SEQ ID NO: 1658 as CDR3;

(620) an antibody that comprises an L chain having the amino acid sequence of SEQ ID NO: 1660 as CDR1, the amino acid sequence of SEQ ID NO: 1662 as CDR2, and the amino acid sequence of SEQ ID NO: 1664 as CDR3;

(621) an antibody that comprises the H chain of (619) and the L chain of (620);

(622) an antibody that comprises an H chain having the amino acid sequence of SEQ ID NO: 2702 as VH;

(623) an antibody that comprises an L chain having the amino acid sequence of SEQ ID NO: 2704 as VL;

(624) an antibody that comprises the H chain of (622) and the L chain of (623);

(625) an antibody that comprises an H chain having the amino acid sequence of SEQ ID NO: 1670 as CDR1, the amino acid sequence of SEQ ID NO: 1672 as CDR2, and the amino acid sequence of SEQ ID NO: 1674 as CDR3;

(626) an antibody that comprises an L chain having the amino acid sequence of SEQ ID NO: 1676 as CDR1, the amino acid sequence of SEQ ID NO: 1678 as CDR2, and the amino acid sequence of SEQ ID NO: 1680 as CDR3;

(627) an antibody that comprises the H chain of (625) and the L chain of (626);

(628) an antibody that comprises an H chain having the amino acid sequence of SEQ ID NO: 2706 as VH;

(629) an antibody that comprises an L chain having the amino acid sequence of SEQ ID NO: 2708 as VL;

(630) an antibody that comprises the H chain of (628) and the L chain of (629);

(631) an antibody that comprises an H chain having the amino acid sequence of SEQ ID NO: 1686 as CDR1, the amino acid sequence of SEQ ID NO: 1688 as CDR2, and the amino acid sequence of SEQ ID NO: 1690 as CDR3;

(632) an antibody that comprises an L chain having the amino acid sequence of SEQ ID NO: 1692 as CDR1, the amino acid sequence of SEQ ID NO: 1694 as CDR2, and the amino acid sequence of SEQ ID NO: 1696 as CDR3;

(633) an antibody that comprises the H chain of (631) and the L chain of (632);

(634) an antibody that comprises an H chain having the amino acid sequence of SEQ ID NO: 2710 as VH;

(635) an antibody that comprises an L chain having the amino acid sequence of SEQ ID NO: 2712 as VL;

(636) an antibody that comprises the H chain of (634) and the L chain of (635);

(637) an antibody that comprises an H chain having the amino acid sequence of SEQ ID NO: 1702 as CDR1, the amino acid sequence of SEQ ID NO: 1704 as CDR2, and the amino acid sequence of SEQ ID NO: 1706 as CDR3;

(638) an antibody that comprises an L chain having the amino acid sequence of SEQ ID NO: 1708 as CDR1, the amino acid sequence of SEQ ID NO: 1710 as CDR2, and the amino acid sequence of SEQ ID NO: 1712 as CDR3;

(639) an antibody that comprises the H chain of (637) and the L chain of (638);

(640) an antibody that comprises an H chain having the amino acid sequence of SEQ ID NO: 2714 as VH;

(641) an antibody that comprises an L chain having the amino acid sequence of SEQ ID NO: 2716 as VL;

(642) an antibody that comprises the H chain of (640) and the L chain of (641);

(643) an antibody that comprises an H chain having the amino acid sequence of SEQ ID NO: 1718 as CDR1, the amino acid sequence of SEQ ID NO: 1720 as CDR2, and the amino acid sequence of SEQ ID NO: 1722 as CDR3;

(644) an antibody that comprises an L chain having the amino acid sequence of SEQ ID NO: 1724 as CDR1, the amino acid sequence of SEQ ID NO: 1726 as CDR2, and the amino acid sequence of SEQ ID NO: 1728 as CDR3;

(645) an antibody that comprises the H chain of (643) and the L chain of (644);

(646) an antibody that comprises an H chain having the amino acid sequence of SEQ ID NO: 2718 as VH;

(647) an antibody that comprises an L chain having the amino acid sequence of SEQ ID NO: 2720 as VL;

(648) an antibody that comprises the H chain of (646) and the L chain of (647);

(649) an antibody that comprises an H chain having the amino acid sequence of SEQ ID NO: 1734 as CDR1, the amino acid sequence of SEQ ID NO: 1736 as CDR2, and the amino acid sequence of SEQ ID NO: 1738 as CDR3;

(650) an antibody that comprises an L chain having the amino acid sequence of SEQ ID NO: 1740 as CDR1, the amino acid sequence of SEQ ID NO: 1742 as CDR2, and the amino acid sequence of SEQ ID NO: 1744 as CDR3;

(651) an antibody that comprises the H chain of (649) and the L chain of (650);

(652) an antibody that comprises an H chain having the amino acid sequence of SEQ ID NO: 2722 as VH;

(653) an antibody that comprises an L chain having the amino acid sequence of SEQ ID NO: 2724 as VL;

(654) an antibody that comprises the H chain of (652) and the L chain of (653);

(655) an antibody that comprises an H chain having the amino acid sequence of SEQ ID NO: 1750 as CDR1, the amino acid sequence of SEQ ID NO: 1752 as CDR2, and the amino acid sequence of SEQ ID NO: 1754 as CDR3;

(656) an antibody that comprises an L chain having the amino acid sequence of SEQ ID NO: 1756 as CDR1, the amino acid sequence of SEQ ID NO: 1758 as CDR2, and the amino acid sequence of SEQ ID NO: 1760 as CDR3;

(657) an antibody that comprises the H chain of (655) and the L chain of (656);

(658) an antibody that comprises an H chain having the amino acid sequence of SEQ ID NO: 2726 as VH;

(659) an antibody that comprises an L chain having the amino acid sequence of SEQ ID NO: 2728 as VL;

(660) an antibody that comprises the H chain of (658) and the L chain of (659);

(661) an antibody that comprises an H chain having the amino acid sequence of SEQ ID NO: 1766 as CDR1, the amino acid sequence of SEQ ID NO: 1768 as CDR2, and the amino acid sequence of SEQ ID NO: 1770 as CDR3;

(662) an antibody that comprises an L chain having the amino acid sequence of SEQ ID NO: 1772 as CDR1, the amino acid sequence of SEQ ID NO: 1774 as CDR2, and the amino acid sequence of SEQ ID NO: 1776 as CDR3;

(663) an antibody that comprises the H chain of (661) and the L chain of (662);

(664) an antibody that comprises an H chain having the amino acid sequence of SEQ ID NO: 2730 as VH;

(665) an antibody that comprises an L chain having the amino acid sequence of SEQ ID NO: 2732 as VL;

(666) an antibody that comprises the H chain of (664) and the L chain of (665);

(667) an antibody that comprises an H chain having the amino acid sequence of SEQ ID NO: 1782 as CDR1, the amino acid sequence of SEQ ID NO: 1784 as CDR2, and the amino acid sequence of SEQ ID NO: 1786 as CDR3;

(668) an antibody that comprises an L chain having the amino acid sequence of SEQ ID NO: 1788 as CDR1, the amino acid sequence of SEQ ID NO: 1790 as CDR2, and the amino acid sequence of SEQ ID NO: 1792 as CDR3;

(669) an antibody that comprises the H chain of (667) and the L chain of (668);

(670) an antibody that comprises an H chain having the amino acid sequence of SEQ ID NO: 2734 as VH;

(671) an antibody that comprises an L chain having the amino acid sequence of SEQ ID NO: 2736 as VL;

(672) an antibody that comprises the H chain of (670) and the L chain of (671);

(673) an antibody that comprises an H chain having the amino acid sequence of SEQ ID NO: 1798 as CDR1, the amino acid sequence of SEQ ID NO: 1800 as CDR2, and the amino acid sequence of SEQ ID NO: 1802 as CDR3;

(674) an antibody that comprises an L chain having the amino acid sequence of SEQ ID NO: 1804 as CDR1, the amino acid sequence of SEQ ID NO: 1806 as CDR2, and the amino acid sequence of SEQ ID NO: 1808 as CDR3;

(675) an antibody that comprises the H chain of (673) and the L chain of (674);

(676) an antibody that comprises an H chain having the amino acid sequence of SEQ ID NO: 2738 as VH;

(677) an antibody that comprises an L chain having the amino acid sequence of SEQ ID NO: 2740 as VL;

(678) an antibody that comprises the H chain of (676) and the L chain of (677);

(679) an antibody that comprises an H chain having the amino acid sequence of SEQ ID NO: 1814 as CDR1, the amino acid sequence of SEQ ID NO: 1816 as CDR2, and the amino acid sequence of SEQ ID NO: 1818 as CDR3;

(680) an antibody that comprises an L chain having the amino acid sequence of SEQ ID NO: 1820 as CDR1, the amino acid sequence of SEQ ID NO: 1822 as CDR2, and the amino acid sequence of SEQ ID NO: 1824 as CDR3;

(681) an antibody that comprises the H chain of (679) and the L chain of (680);

(682) an antibody that comprises an H chain having the amino acid sequence of SEQ ID NO: 2742 as VH;

(683) an antibody that comprises an L chain having the amino acid sequence of SEQ ID NO: 2744 as VL;

(684) an antibody that comprises the H chain of (682) and the L chain of (683);

(685) an antibody that comprises an H chain having the amino acid sequence of SEQ ID NO: 1830 as CDR1, the amino acid sequence of SEQ ID NO: 1832 as CDR2, and the amino acid sequence of SEQ ID NO: 1834 as CDR3;

(686) an antibody that comprises an L chain having the amino acid sequence of SEQ ID NO: 1836 as CDR1, the amino acid sequence of SEQ ID NO: 1838 as CDR2, and the amino acid sequence of SEQ ID NO: 1840 as CDR3;

(687) an antibody that comprises the H chain of (685) and the L chain of (686);

(688) an antibody that comprises an H chain having the amino acid sequence of SEQ ID NO: 2746 as VH;

(689) an antibody that comprises an L chain having the amino acid sequence of SEQ ID NO: 2748 as VL;

(690) an antibody that comprises the H chain of (688) and the L chain of (689);

(691) an antibody that comprises an H chain having the amino acid sequence of SEQ ID NO: 1846 as CDR1, the amino acid sequence of SEQ ID NO: 1848 as CDR2, and the amino acid sequence of SEQ ID NO: 1850 as CDR3;

(692) an antibody that comprises an L chain having the amino acid sequence of SEQ ID NO: 1852 as CDR1, the amino acid sequence of SEQ ID NO: 1854 as CDR2, and the amino acid sequence of SEQ ID NO: 1856 as CDR3;

(693) an antibody that comprises the H chain of (691) and the L chain of (692);

(694) an antibody that comprises an H chain having the amino acid sequence of SEQ ID NO: 2750 as VH;

(695) an antibody that comprises an L chain having the amino acid sequence of SEQ ID NO: 2752 as VL;

(696) an antibody that comprises the H chain of (694) and the L chain of (695);

(697) an antibody that comprises an H chain having the amino acid sequence of SEQ ID NO: 1862 as CDR1, the amino acid sequence of SEQ ID NO: 1864 as CDR2, and the amino acid sequence of SEQ ID NO: 1866 as CDR3;

(698) an antibody that comprises an L chain having the amino acid sequence of SEQ ID NO: 1868 as CDR1, the amino acid sequence of SEQ ID NO: 1870 as CDR2, and the amino acid sequence of SEQ ID NO: 1872 as CDR3;

(699) an antibody that comprises the H chain of (697) and the L chain of (698);

(700) an antibody that comprises an H chain having the amino acid sequence of SEQ ID NO: 2754 as VH;

(701) an antibody that comprises an L chain having the amino acid sequence of SEQ ID NO: 2756 as VL;

(702) an antibody that comprises the H chain of (700) and the L chain of (701);

(703) an antibody that comprises an H chain having the amino acid sequence of SEQ ID NO: 1878 as CDR1, the amino acid sequence of SEQ ID NO: 1880 as CDR2, and the amino acid sequence of SEQ ID NO: 1882 as CDR3;

(704) an antibody that comprises an L chain having the amino acid sequence of SEQ ID NO: 1884 as CDR1, the amino acid sequence of SEQ ID NO: 1886 as CDR2, and the amino acid sequence of SEQ ID NO: 1888 as CDR3;

(705) an antibody that comprises the H chain of (703) and the L chain of (704);

(706) an antibody that comprises an H chain having the amino acid sequence of SEQ ID NO: 2758 as VH;

(707) an antibody that comprises an L chain having the amino acid sequence of SEQ ID NO: 2760 as VL;

(708) an antibody that comprises the H chain of (706) and the L chain of (707);

(709) an antibody that comprises an H chain having the amino acid sequence of SEQ ID NO: 1894 as CDR1, the amino acid sequence of SEQ ID NO: 1896 as CDR2, and the amino acid sequence of SEQ ID NO: 1898 as CDR3;

(710) an antibody that comprises an L chain having the amino acid sequence of SEQ ID NO: 1900 as CDR1, the amino acid sequence of SEQ ID NO: 1902 as CDR2, and the amino acid sequence of SEQ ID NO: 1904 as CDR3;

(711) an antibody that comprises the H chain of (709) and the L chain of (710);

(712) an antibody that comprises an H chain having the amino acid sequence of SEQ ID NO: 2762 as VH;

(713) an antibody that comprises an L chain having the amino acid sequence of SEQ ID NO: 2764 as VL;

(714) an antibody that comprises the H chain of (712) and the L chain of (713);

(715) an antibody that comprises an H chain having the amino acid sequence of SEQ ID NO: 1910 as CDR1, the amino acid sequence of SEQ ID NO: 1912 as CDR2, and the amino acid sequence of SEQ ID NO: 1914 as CDR3;

(716) an antibody that comprises an L chain having the amino acid sequence of SEQ ID NO: 1916 as CDR1, the amino acid sequence of SEQ ID NO: 1918 as CDR2, and the amino acid sequence of SEQ ID NO: 1920 as CDR3;

(717) an antibody that comprises the H chain of (715) and the L chain of (716);

(718) an antibody that comprises an H chain having the amino acid sequence of SEQ ID NO: 2766 as VH;

(719) an antibody that comprises an L chain having the amino acid sequence of SEQ ID NO: 2768 as VL;

(720) an antibody that comprises the H chain of (718) and the L chain of (719);

(721) an antibody that comprises an H chain having the amino acid sequence of SEQ ID NO: 1926 as CDR1, the amino acid sequence of SEQ ID NO: 1928 as CDR2, and the amino acid sequence of SEQ ID NO: 1930 as CDR3;

(722) an antibody that comprises an L chain having the amino acid sequence of SEQ ID NO: 1932 as CDR1, the amino acid sequence of SEQ ID NO: 1934 as CDR2, and the amino acid sequence of SEQ ID NO: 1936 as CDR3;

(723) an antibody that comprises the H chain of (721) and the L chain of (722);

(724) an antibody that comprises an H chain having the amino acid sequence of SEQ ID NO: 2770 as VH;

(725) an antibody that comprises an L chain having the amino acid sequence of SEQ ID NO: 2772 as VL;

(726) an antibody that comprises the H chain of (724) and the L chain of (725);

(727) an antibody that comprises an H chain having the amino acid sequence of SEQ ID NO: 1942 as CDR1, the amino acid sequence of SEQ ID NO: 1944 as CDR2, and the amino acid sequence of SEQ ID NO: 1946 as CDR3;

(728) an antibody that comprises an L chain having the amino acid sequence of SEQ ID NO: 1948 as CDR1, the amino acid sequence of SEQ ID NO: 1950 as CDR2, and the amino acid sequence of SEQ ID NO: 1952 as CDR3;

(729) an antibody that comprises the H chain of (727) and the L chain of (728);

(730) an antibody that comprises an H chain having the amino acid sequence of SEQ ID NO: 2774 as VH;

(731) an antibody that comprises an L chain having the amino acid sequence of SEQ ID NO: 2776 as VL;

(732) an antibody that comprises the H chain of (730) and the L chain of (731);

(733) an antibody that comprises an H chain having the amino acid sequence of SEQ ID NO: 1958 as CDR1, the amino acid sequence of SEQ ID NO: 1960 as CDR2, and the amino acid sequence of SEQ ID NO: 1962 as CDR3;

(734) an antibody that comprises an L chain having the amino acid sequence of SEQ ID NO: 1964 as CDR1, the amino acid sequence of SEQ ID NO: 1966 as CDR2, and the amino acid sequence of SEQ ID NO: 1968 as CDR3;

(735) an antibody that comprises the H chain of (733) and the L chain of (734);

(736) an antibody that comprises an H chain having the amino acid sequence of SEQ ID NO: 2778 as VH;

(737) an antibody that comprises an L chain having the amino acid sequence of SEQ ID NO: 2780 as VL;

(738) an antibody that comprises the H chain of (736) and the L chain of (737);

(739) an antibody that comprises an H chain having the amino acid sequence of SEQ ID NO: 1974 as CDR1, the amino acid sequence of SEQ ID NO: 1976 as CDR2, and the amino acid sequence of SEQ ID NO: 1978 as CDR3;

(740) an antibody that comprises an L chain having the amino acid sequence of SEQ ID NO: 1980 as CDR1, the amino acid sequence of SEQ ID NO: 1982 as CDR2, and the amino acid sequence of SEQ ID NO: 1984 as CDR3;

(741) an antibody that comprises the H chain of (739) and the L chain of (740);

(742) an antibody that comprises an H chain having the amino acid sequence of SEQ ID NO: 2782 as VH;

(743) an antibody that comprises an L chain having the amino acid sequence of SEQ ID NO: 2784 as VL;

(744) an antibody that comprises the H chain of (742) and the L chain of (743);

(745) an antibody that comprises an H chain having the amino acid sequence of SEQ ID NO: 1990 as CDR1, the amino acid sequence of SEQ ID NO: 1992 as CDR2, and the amino acid sequence of SEQ ID NO: 1994 as CDR3;

(746) an antibody that comprises an L chain having the amino acid sequence of SEQ ID NO: 1996 as CDR1, the amino acid sequence of SEQ ID NO: 1998 as CDR2, and the amino acid sequence of SEQ ID NO: 2000 as CDR3;

(747) an antibody that comprises the H chain of (745) and the L chain of (746);

(748) an antibody that comprises an H chain having the amino acid sequence of SEQ ID NO: 2786 as VH;

(749) an antibody that comprises an L chain having the amino acid sequence of SEQ ID NO: 2788 as VL;

(750) an antibody that comprises the H chain of (748) and the L chain of (749);

(751) an antibody that comprises an H chain having the amino acid sequence of SEQ ID NO: 2006 as CDR1, the amino acid sequence of SEQ ID NO: 2008 as CDR2, and the amino acid sequence of SEQ ID NO: 2010 as CDR3;

(752) an antibody that comprises an L chain having the amino acid sequence of SEQ ID NO: 2012 as CDR1, the amino acid sequence of SEQ ID NO: 2014 as CDR2, and the amino acid sequence of SEQ ID NO: 2016 as CDR3;

(753) an antibody that comprises the H chain of (751) and the L chain of (752);

(754) an antibody that comprises an H chain having the amino acid sequence of SEQ ID NO: 2790 as VH;

(755) an antibody that comprises an L chain having the amino acid sequence of SEQ ID NO: 2792 as VL;

(756) an antibody that comprises the H chain of (754) and the L chain of (755);

(757) an antibody that comprises an H chain having the amino acid sequence of SEQ ID NO: 2022 as CDR1, the amino acid sequence of SEQ ID NO: 2024 as CDR2, and the amino acid sequence of SEQ ID NO: 2026 as CDR3;

(758) an antibody that comprises an L chain having the amino acid sequence of SEQ ID NO: 2028 as CDR1, the amino acid sequence of SEQ ID NO: 2030 as CDR2, and the amino acid sequence of SEQ ID NO: 2032 as CDR3;

(759) an antibody that comprises the H chain of (757) and the L chain of (758);

(760) an antibody that comprises an H chain having the amino acid sequence of SEQ ID NO: 2794 as VH;

(761) an antibody that comprises an L chain having the amino acid sequence of SEQ ID NO: 2796 as VL;

(762) an antibody that comprises the H chain of (760) and the L chain of (761);

(763) an antibody that comprises an H chain having the amino acid sequence of SEQ ID NO: 2038 as CDR1, the amino acid sequence of SEQ ID NO: 2040 as CDR2, and the amino acid sequence of SEQ ID NO: 2042 as CDR3;

(764) an antibody that comprises an L chain having the amino acid sequence of SEQ ID NO: 2044 as CDR1, the amino acid sequence of SEQ ID NO: 2046 as CDR2, and the amino acid sequence of SEQ ID NO: 2048 as CDR3;

(765) an antibody that comprises the H chain of (763) and the L chain of (764);

(766) an antibody that comprises an H chain having the amino acid sequence of SEQ ID NO: 2798 as VH;

(767) an antibody that comprises an L chain having the amino acid sequence of SEQ ID NO: 2800 as VL;

(768) an antibody that comprises the H chain of (766) and the L chain of (767);

(769) an antibody that comprises an H chain having the amino acid sequence of SEQ ID NO: 2054 as CDR1, the amino acid sequence of SEQ ID NO: 2056 as CDR2, and the amino acid sequence of SEQ ID NO: 2058 as CDR3;

(770) an antibody that comprises an L chain having the amino acid sequence of SEQ ID NO: 2060 as CDR1, the amino acid sequence of SEQ ID NO: 2062 as CDR2, and the amino acid sequence of SEQ ID NO: 2064 as CDR3;

(771) an antibody that comprises the H chain of (769) and the L chain of (770);

(772) an antibody that comprises an H chain having the amino acid sequence of SEQ ID NO: 2802 as VH;

(773) an antibody that comprises an L chain having the amino acid sequence of SEQ ID NO: 2804 as VL;

(774) an antibody that comprises the H chain of (772) and the L chain of (773);

(775) an antibody that comprises an H chain having the amino acid sequence of SEQ ID NO: 2070 as CDR1, the amino acid sequence of SEQ ID NO: 2072 as CDR2, and the amino acid sequence of SEQ ID NO: 2074 as CDR3;

(776) an antibody that comprises an L chain having the amino acid sequence of SEQ ID NO: 2076 as CDR1, the amino acid sequence of SEQ ID NO: 2078 as CDR2, and the amino acid sequence of SEQ ID NO: 2080 as CDR3;

(777) an antibody that comprises the H chain of (775) and the L chain of (776);

(778) an antibody that comprises an H chain having the amino acid sequence of SEQ ID NO: 2806 as VH;

(779) an antibody that comprises an L chain having the amino acid sequence of SEQ ID NO: 2808 as VL;

(780) an antibody that comprises the H chain of (778) and the L chain of (779);

(781) an antibody that comprises an H chain having the amino acid sequence of SEQ ID NO: 2086 as CDR1, the amino acid sequence of SEQ ID NO: 2088 as CDR2, and the amino acid sequence of SEQ ID NO: 2090 as CDR3;

(782) an antibody that comprises an L chain having the amino acid sequence of SEQ ID NO: 2092 as CDR1, the amino acid sequence of SEQ ID NO: 2094 as CDR2, and the amino acid sequence of SEQ ID NO: 2096 as CDR3;

(783) an antibody that comprises the H chain of (781) and the L chain of (782);

(784) an antibody that comprises an H chain having the amino acid sequence of SEQ ID NO: 2810 as VH;

(785) an antibody that comprises an L chain having the amino acid sequence of SEQ ID NO: 2812 as VL;

(786) an antibody that comprises the H chain of (784) and the L chain of (785);

(787) an antibody that comprises an H chain having the amino acid sequence of SEQ ID NO: 2102 as CDR1, the amino acid sequence of SEQ ID NO: 2104 as CDR2, and the amino acid sequence of SEQ ID NO: 2106 as CDR3;

(788) an antibody that comprises an L chain having the amino acid sequence of SEQ ID NO: 2108 as CDR1, the amino acid sequence of SEQ ID NO: 2110 as CDR2, and the amino acid sequence of SEQ ID NO: 2112 as CDR3;

(789) an antibody that comprises the H chain of (787) and the L chain of (788);

(790) an antibody that comprises an H chain having the amino acid sequence of SEQ ID NO: 2814 as VH;

(791) an antibody that comprises an L chain having the amino acid sequence of SEQ ID NO: 2816 as VL;

(792) an antibody that comprises the H chain of (790) and the L chain of (791);

(793) an antibody that comprises an H chain having the amino acid sequence of SEQ ID NO: 2118 as CDR1, the amino acid sequence of SEQ ID NO: 2120 as CDR2, and the amino acid sequence of SEQ ID NO: 2122 as CDR3;

(794) an antibody that comprises an L chain having the amino acid sequence of SEQ ID NO: 2124 as CDR1, the amino acid sequence of SEQ ID NO: 2126 as CDR2, and the amino acid sequence of SEQ ID NO: 2128 as CDR3;

(795) an antibody that comprises the H chain of (793) and the L chain of (794);

(796) an antibody that comprises an H chain having the amino acid sequence of SEQ ID NO: 2818 as VH;

(797) an antibody that comprises an L chain having the amino acid sequence of SEQ ID NO: 2820 as VL;

(798) an antibody that comprises the H chain of (796) and the L chain of (797);

(799) an antibody that comprises an H chain having the amino acid sequence of SEQ ID NO: 2134 as CDR1, the amino acid sequence of SEQ ID NO: 2136 as CDR2, and the amino acid sequence of SEQ ID NO: 2138 as CDR3;

(800) an antibody that comprises an L chain having the amino acid sequence of SEQ ID NO: 2140 as CDR1, the amino acid sequence of SEQ ID NO: 2142 as CDR2, and the amino acid sequence of SEQ ID NO: 2144 as CDR3;

(801) an antibody that comprises the H chain of (799) and the L chain of (800);

(802) an antibody that comprises an H chain having the amino acid sequence of SEQ ID NO: 2822 as VH;

(803) an antibody that comprises an L chain having the amino acid sequence of SEQ ID NO: 2824 as VL;

(804) an antibody that comprises the H chain of (802) and the L chain of (803);

(805) an antibody that comprises an H chain having the amino acid sequence of SEQ ID NO: 2150 as CDR1, the amino acid sequence of SEQ ID NO: 2152 as CDR2, and the amino acid sequence of SEQ ID NO: 2154 as CDR3;

(806) an antibody that comprises an L chain having the amino acid sequence of SEQ ID NO: 2156 as CDR1, the amino acid sequence of SEQ ID NO: 2158 as CDR2, and the amino acid sequence of SEQ ID NO: 2160 as CDR3;

(807) an antibody that comprises the H chain of (805) and the L chain of (806);

(808) an antibody that comprises an H chain having the amino acid sequence of SEQ ID NO: 2826 as VH;

(809) an antibody that comprises an L chain having the amino acid sequence of SEQ ID NO: 2828 as VL;

(810) an antibody that comprises the H chain of (808) and the L chain of (809);

(811) an antibody that comprises an H chain having the amino acid sequence of SEQ ID NO: 2166 as CDR1, the amino acid sequence of SEQ ID NO: 2168 as CDR2, and the amino acid sequence of SEQ ID NO: 2170 as CDR3;

(812) an antibody that comprises an L chain having the amino acid sequence of SEQ ID NO: 2172 as CDR1, the amino acid sequence of SEQ ID NO: 2174 as CDR2, and the amino acid sequence of SEQ ID NO: 2176 as CDR3;

(813) an antibody that comprises the H chain of (811) and the L chain of (812);

(814) an antibody that comprises an H chain having the amino acid sequence of SEQ ID NO: 2830 as VH;

(815) an antibody that comprises an L chain having the amino acid sequence of SEQ ID NO: 2832 as VL;

(816) an antibody that comprises the H chain of (814) and the L chain of (815);

(817) an antibody that comprises an H chain having the amino acid sequence of SEQ ID NO: 2182 as CDR1, the amino acid sequence of SEQ ID NO: 2184 as CDR2, and the amino acid sequence of SEQ ID NO: 2186 as CDR3;

(818) an antibody that comprises an L chain having the amino acid sequence of SEQ ID NO: 2188 as CDR1, the amino acid sequence of SEQ ID NO: 2190 as CDR2, and the amino acid sequence of SEQ ID NO: 2192 as CDR3;

(819) an antibody that comprises the H chain of (817) and the L chain of (818);

(820) an antibody that comprises an H chain having the amino acid sequence of SEQ ID NO: 2834 as VH;

(821) an antibody that comprises an L chain having the amino acid sequence of SEQ ID NO: 2836 as VL;

(822) an antibody that comprises the H chain of (820) and the L chain of (821);

(823) an antibody that comprises an H chain having the amino acid sequence of SEQ ID NO: 2198 as CDR1, the amino acid sequence of SEQ ID NO: 2200 as CDR2, and the amino acid sequence of SEQ ID NO: 2202 as CDR3;

(824) an antibody that comprises an L chain having the amino acid sequence of SEQ ID NO: 2204 as CDR1, the amino acid sequence of SEQ ID NO: 2206 as CDR2, and the amino acid sequence of SEQ ID NO: 2208 as CDR3;

(825) an antibody that comprises the H chain of (823) and the L chain of (824);

(826) an antibody that comprises an H chain having the amino acid sequence of SEQ ID NO: 2838 as VH;

(827) an antibody that comprises an L chain having the amino acid sequence of SEQ ID NO: 2840 as VL;

(828) an antibody that comprises the H chain of (826) and the L chain of (827);

(829) an antibody that comprises an H chain having the amino acid sequence of SEQ ID NO: 2214 as CDR1, the amino acid sequence of SEQ ID NO: 2216 as CDR2, and the amino acid sequence of SEQ ID NO: 2218 as CDR3;

(830) an antibody that comprises an L chain having the amino acid sequence of SEQ ID NO: 2220 as CDR1, the amino acid sequence of SEQ ID NO: 2222 as CDR2, and the amino acid sequence of SEQ ID NO: 2224 as CDR3;

(831) an antibody that comprises the H chain of (829) and the L chain of (830);

(832) an antibody that comprises an H chain having the amino acid sequence of SEQ ID NO: 2842 as VH;

(833) an antibody that comprises an L chain having the amino acid sequence of SEQ ID NO: 2844 as VL;

(834) an antibody that comprises the H chain of (832) and the L chain of (833);

(835) an antibody that comprises an H chain having the amino acid sequence of SEQ ID NO: 2230 as CDR1, the amino acid sequence of SEQ ID NO: 2232 as CDR2, and the amino acid sequence of SEQ ID NO: 2234 as CDR3;

(836) an antibody that comprises an L chain having the amino acid sequence of SEQ ID NO: 2236 as CDR1, the amino acid sequence of SEQ ID NO: 2238 as CDR2, and the amino acid sequence of SEQ ID NO: 2240 as CDR3;

(837) an antibody that comprises the H chain of (835) and the L chain of (836);

(838) an antibody that comprises an H chain having the amino acid sequence of SEQ ID NO: 2846 as VH;

(839) an antibody that comprises an L chain having the amino acid sequence of SEQ ID NO: 2848 as VL;

(840) an antibody that comprises the H chain of (838) and the L chain of (839);

(841) an antibody that comprises an H chain having the amino acid sequence of SEQ ID NO: 2246 as CDR1, the amino acid sequence of SEQ ID NO: 2248 as CDR2, and the amino acid sequence of SEQ ID NO: 2250 as CDR3;

(842) an antibody that comprises an L chain having the amino acid sequence of SEQ ID NO: 2252 as CDR1, the amino acid sequence of SEQ ID NO: 2254 as CDR2, and the amino acid sequence of SEQ ID NO: 2256 as CDR3;

(843) an antibody that comprises the H chain of (841) and the L chain of (842);

(844) an antibody that comprises an H chain having the amino acid sequence of SEQ ID NO: 2850 as VH;

(845) an antibody that comprises an L chain having the amino acid sequence of SEQ ID NO: 2852 as VL;

(846) an antibody that comprises the H chain of (844) and the L chain of (845);

(847) an antibody that comprises an H chain having the amino acid sequence of SEQ ID NO: 2262 as CDR1, the amino acid sequence of SEQ ID NO: 2264 as CDR2, and the amino acid sequence of SEQ ID NO: 2266 as CDR3;

(848) an antibody that comprises an L chain having the amino acid sequence of SEQ ID NO: 2268 as CDR1, the amino acid sequence of SEQ ID NO: 2270 as CDR2, and the amino acid sequence of SEQ ID NO: 2272 as CDR3;

(849) an antibody that comprises the H chain of (847) and the L chain of (848);

(850) an antibody that comprises an H chain having the amino acid sequence of SEQ ID NO: 2854 as VH;

(851) an antibody that comprises an L chain having the amino acid sequence of SEQ ID NO: 2856 as VL;

(852) an antibody that comprises the H chain of (850) and the L chain of (851);

(853) an antibody that comprises an H chain having the amino acid sequence of SEQ ID NO: 2278 as CDR1, the amino acid sequence of SEQ ID NO: 2280 as CDR2, and the amino acid sequence of SEQ ID NO: 2282 as CDR3;

(854) an antibody that comprises an L chain having the amino acid sequence of SEQ ID NO: 2284 as CDR1, the amino acid sequence of SEQ ID NO: 2286 as CDR2, and the amino acid sequence of SEQ ID NO: 2288 as CDR3;

(855) an antibody that comprises the H chain of (853) and the L chain of (854);

(856) an antibody that comprises an H chain having the amino acid sequence of SEQ ID NO: 2858 as VH;

(857) an antibody that comprises an L chain having the amino acid sequence of SEQ ID NO: 2860 as VL;

(858) an antibody that comprises the H chain of (856) and the L chain of (857);

(859) an antibody that comprises an H chain having the amino acid sequence of SEQ ID NO: 2866 as CDR1, the amino acid sequence of SEQ ID NO: 2868 as CDR2, and the amino acid sequence of SEQ ID NO: 2870 as CDR3;

(860) an antibody that comprises an L chain having the amino acid sequence of SEQ ID NO: 2872 as CDR1, the amino acid sequence of SEQ ID NO: 2874 as CDR2, and the amino acid sequence of SEQ ID NO: 2876 as CDR3;

(861) an antibody that comprises the H chain of (859) and the L chain of (860);

(862) an antibody that comprises an H chain having the amino acid sequence of SEQ ID NO: 2862 as VH;

(863) an antibody that comprises an L chain having the amino acid sequence of SEQ ID NO: 2864 as VL;

(864) an antibody that comprises the H chain of (862) and the L chain of (863);

(865) an antibody that comprises an H chain having the amino acid sequence of SEQ ID NO: 2882 as CDR1, the amino acid sequence of SEQ ID NO: 2884 as CDR2, and the amino acid sequence of SEQ ID NO: 2886 as CDR3;

(866) an antibody that comprises an L chain having the amino acid sequence of SEQ ID NO: 2888 as CDR1, the amino acid sequence of SEQ ID NO: 2890 as CDR2, and the amino acid sequence of SEQ ID NO: 2892 as CDR3;

(867) an antibody that comprises the H chain of (865) and the L chain of (866);

(868) an antibody that comprises an H chain having the amino acid sequence of SEQ ID NO: 2878 as VH;

(869) an antibody that comprises an L chain having the amino acid sequence of SEQ ID NO: 2880 as VL;

(870) an antibody that comprises the H chain of (868) and the L chain of (869);

(871) an antibody that comprises one or more amino acid substitutions, deletions, additions, and/or insertions in the antibody of any one of (1) to (870), which has equivalent activity to the antibody of any one of (1) to (870); and (872) an antibody that binds to the epitope bound by the antibody of any one of (1) to (870).

[4] The antibody of any one of [1] to [3], wherein the antibody is a chimeric antibody or a humanized antibody.

[5] An antigen-binding fragment of the antibody of any one of [1] to [4].

[6] A pharmaceutical composition comprising the antibody of any one of [1] to [4] or the antigen-binding fragment of [5], and a pharmaceutically acceptable carrier.

[7] The composition of [6], which is an agent against cognitive impairment, a therapeutic agent for Alzheimer's disease, an agent for suppressing the progression of Alzheimer's disease, an agent for suppressing senile plaque formation, an agent for suppressing A beta accumulation, an anti-neurotoxic agent, an agent for inhibiting A beta amyloid fibril formation, or an agent against synaptic toxicity.

[8] A method for detecting an A beta oligomer, which comprises the step of detecting an A beta oligomer contained in a sample using the antibody of any one of [1] to [4] or the antigen-binding fragment of [5].

[9] A method of diagnosing whether or not a subject is a possible Alzheimer's disease patient, which comprises using the antibody of any one of [1] to [4] or the antigen-binding fragment of [5], to detect an A beta oligomer in a sample collected from a subject.

[10] A method of diagnosing whether or not a subject is a possible Alzheimer's disease patient, which comprises the steps of:
(a) contacting a sample collected from a subject with the antibody of any one of [1] to [4] or the antigen-binding fragment of [5]; and
(b) measuring the amount of A beta oligomer in the sample,
wherein the subject is determined to be a possible Alzheimer's disease patient, when the amount measured in step (b) is higher than that of a healthy individual.

[11] A method of diagnosing whether or not a subject is a possible Alzheimer's disease patient, which comprises the steps of:
(a) contacting a sample collected from a subject with the antibody of any one of [1] to [4] or the antigen-binding fragment of [5], and an antibody that binds to an A beta monomer; and
(b) measuring the ratio of A beta oligomer to A beta monomer in the sample,
wherein the subject is determined to be a possible Alzheimer's disease patient, when the ratio measured in step (b) is higher than that of a healthy individual.

[12] The method of any one of [8] to [11], wherein the sample is blood or cerebrospinal fluid.

[13] An agent for use in the method of any one of [8] to [12].

[14] A kit for use in the method of any one of [8] to [12]. Furthermore, the present invention provides the following:

[15] Use of the antibody of any one of [1] to [4] or the antigen-binding fragment of [5] for the manufacture of an agent against cognitive impairment, a therapeutic agent for Alzheimer's disease, an agent for suppressing the progression of Alzheimer's disease, an agent for suppressing senile plaque formation, an agent for suppressing A beta accumulation, an anti-neurotoxic agent, an agent for inhibiting A beta amyloid fibril formation, or an agent against synaptic toxicity.

[16] The antibody of any one of [1] to [4] or the antigen-binding fragment of [5] for use in preventing and/or treating cognitive impairment.

[17] The antibody of any one of [1] to [4] or the antigen-binding fragment of [5] for use in preventing and/or treating Alzheimer's disease.

[18] The antibody of any one of [1] to [4] or the antigen-binding fragment of [5] for use in suppressing the progression of Alzheimer's disease.

[19] The antibody of any one of [1] to [4] or the antigen-binding fragment of [5] for use in suppressing senile plaque formation.

[20] The antibody of any one of [1] to [4] or the antigen-binding fragment of [5] for use in suppressing A beta accumulation.

[21] The antibody of any one of [1] to [4] or the antigen-binding fragment of [5] for use in neutralizing (suppressing) neurotoxicity.

[22] The antibody of any one of [1] to [4] or the antigen-binding fragment of [5] for use in inhibiting A beta amyloid fibril formation.

[23] The antibody of any one of [1] to [4] or the antigen-binding fragment of [5] for use in neutralizing (suppressing) synaptic toxicity.

[24] A method for preventing and/or treating cognitive impairment, which comprises the step of administering a therapeutically effective amount of the antibody of any one of [1] to [4] or the antigen-binding fragment of [5].

[25] A method for preventing and/or treating Alzheimer's disease, which comprises the step of administering a therapeutically effective amount of the antibody of any one of [1] to [4] or the antigen-binding fragment of [5].

[26] A method for suppressing the progression of Alzheimer's disease, which comprises the step of administering a therapeutically effective amount of the antibody of any one of [1] to [4] or the antigen-binding fragment of [5].

[27] A method for suppressing senile plaque formation, which comprises the step of administering a therapeutically effective amount of the antibody of any one of [1] to [4] or the antigen-binding fragment of [5].

[28] A method for suppressing A beta accumulation, which comprises the step of administering a therapeutically effective amount of the antibody of any one of [1] to [4] or the antigen-binding fragment of [5].

[29] A method for neutralizing neurotoxicity, which comprises the step of administering a therapeutically effective amount of the antibody of any one of [1] to [4] or the antigen-binding fragment of [5].

[30] A method for inhibiting A beta amyloid fibril formation, which comprises the step of administering a therapeutically effective amount of the antibody of any one of [1] to [4] or the antigen-binding fragment of [5].

[31] A method for neutralizing synaptic toxicity, which comprises the step of administering a therapeutically effective amount of the antibody of any one of [1] to [4] or the antigen-binding fragment of [5].

[32] Use of the antibody of any one of [1] to [4] or the antigen-binding fragment of [5] for preventing and/or treating cognitive impairment.

[33] Use of the antibody of any one of [1] to [4] or the antigen-binding fragment of [5] for preventing and/or treating Alzheimer's disease.

[34] Use of the antibody of any one of [1] to [4] or the antigen-binding fragment of [5] for suppressing the progression of Alzheimer's disease.

[35] Use of the antibody of any one of [1] to [4] or the antigen-binding fragment of [5] for suppressing senile plaque formation.

[36] Use of the antibody of any one of [1] to [4] or the antigen-binding fragment of [5] for suppressing A beta accumulation.

[37] Use of the antibody of any one of [1] to [4] or the antigen-binding fragment of [5] for neutralizing neurotoxicity.

[38] Use of the antibody of any one of [1] to [4] or the antigen-binding fragment of [5] for inhibiting A beta amyloid fibril formation.

[39] Use of the antibody of any one of [1] to [4] or the antigen-binding fragment of [5] for neutralizing (suppressing) synaptic toxicity.

Advantageous Effects of Invention

The antibodies provided by the present invention are expected to contribute to the establishment of preventive/therapeutic methods selective to molecules responsible for evoking pathological conditions of Alzheimer's disease, and the establishment of early diagnostic markers for Alzheimer's disease.

BRIEF DESCRIPTION OF DRAWINGS

FIG. 1-1 presents photographs of dot-blot analysis results on each of the antibodies.

FIG. 1-2 presents photographs of dot-blot analysis results on each of the antibodies.

FIG. 1-3 presents photographs of dot-blot analysis results on each of the antibodies.

FIG. 2-1 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-2 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-3 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-4 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-5 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-6 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 2-7 presents competitive ELISA results on each of the antibodies. The vertical axis shows the absorbance at a wavelength of 450 nm, and horizontal axis shows the concentration of A beta oligomer or monomer (mg/ml) used as an inhibitor. The dotted lines of each graph show the antigen binding activity when the A beta oligomer was used as an inhibitor. The solid lines of each graph show the antigen binding activity when the A beta monomer was used as an inhibitor.

FIG. 3-1 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-2 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-3 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-4 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-5 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-6 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-7 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-8 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-9 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-10 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 3-11 presents competitive ELISA results on each of the antibodies in which the inhibitor concentration is shown as molar concentration. The vertical axis shows the absorbance at a wavelength of 450 nm, and horizontal axis shows the molar concentration of A beta oligomer or monomer (mol/L) used as an inhibitor. The molar concentration (mol/L) of A beta oligomer was calculated by converting the molar number of A beta oligomer into that of A beta monomer.

FIG. 4-1 shows the results of analysis of the affinity of each of the antibodies to A beta oligomers, by Biacore 3000.

FIG. 4-2 shows the results of analysis of the affinity of each of the antibodies to A beta oligomers, by Biacore 3000.

FIG. 4-3 shows the results of analysis of the affinity of each of the antibodies to A beta oligomers, by Biacore 3000.

FIG. 4-4 shows the results of analysis of the affinity of each of the antibodies to A beta oligomers, by Biacore 3000.

FIG. 4-5 shows the results of analysis of the affinity of each of the antibodies to A beta oligomers, by Biacore 3000.

FIG. 5-1 shows the results of neutralization assay against A beta-induced cytotoxicity using each of the antibodies.

FIG. 5-2 shows the results of neutralization assay against A beta-induced cytotoxicity using each of the antibodies.

FIG. 6-1 shows the results of inhibition assay against A beta fibril formation using each of the antibodies.

FIG. 6-2 shows the results of inhibition assay against A beta fibril formation using each of the antibodies.

FIG. 6-3 shows the results of inhibition assay against A beta fibril formation using each of the antibodies.

FIG. 6-4 shows the results of inhibition assay against A beta fibril formation using each of the antibodies.

FIG. 6-5 shows the results of inhibition assay against A beta fibril formation using each of the antibodies.

FIG. 6-6 shows the results of inhibition assay against A beta fibril formation using each of the antibodies.

FIG. 6-7 shows the results of inhibition assay against A beta fibril formation using each of the antibodies.

FIG. 7-1 shows the results of immunoblotting assay to assess whether each of the antibodies bind to human APP. Human APP was detected in the result of Tg2576 using control antibody 6E10, which is marked by the arrow.

FIG. 7-2 shows the results of immunoblotting assay to assess whether each of the antibodies bind to human APP. Human APP was detected in the result of Tg2576 using control antibody 6E10, which is marked by the arrow.

DESCRIPTION OF EMBODIMENTS

Figures 1, 2:
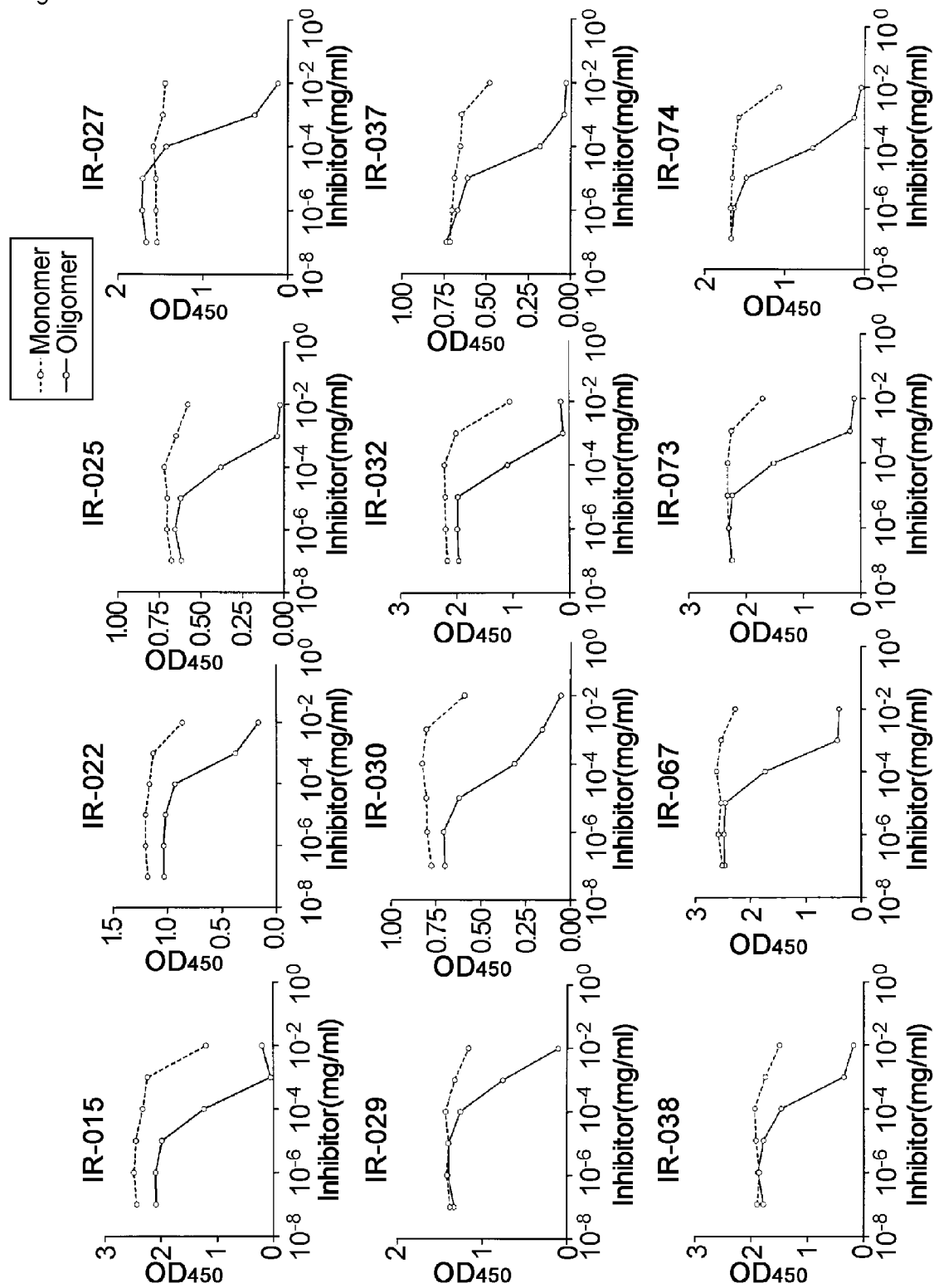
Figure 2:
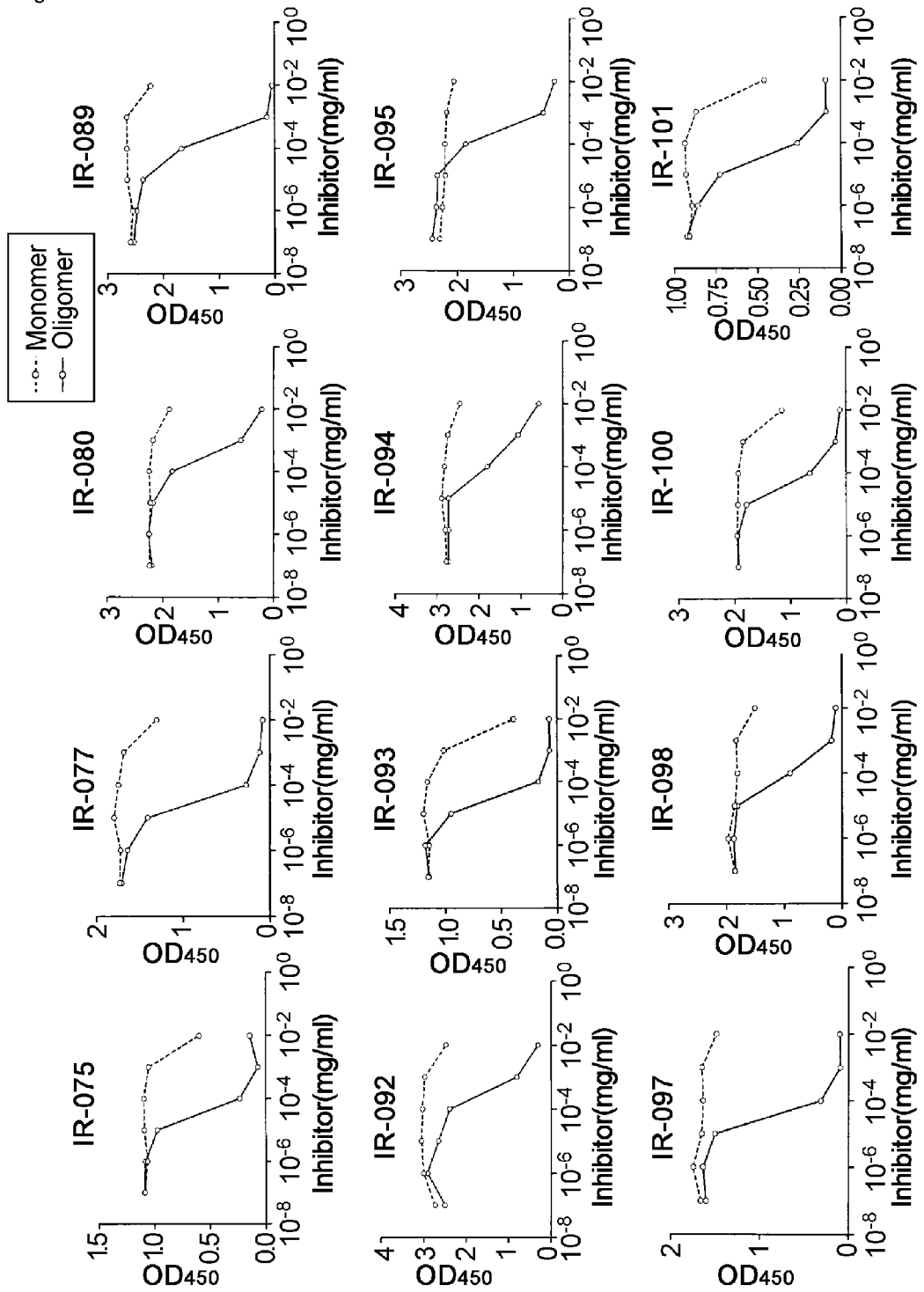

The present invention will be described more specifically below.

As described above, the present inventors succeeded in obtaining antibodies that bind specifically to A beta oligomers but not to A beta monomers. That is, the present invention provides antibodies that bind to A beta oligomers but not to A beta monomers. Furthermore, the present invention provides antibodies that bind to A beta oligomers but not to A beta monomers and amyloid precursor protein (APP). The antibodies are preferably isolated or purified.

The terms "isolated" and "purified" used for substances (antibodies and such) of the present invention indicate that the substances do not substantially include at least one other substance that may be contained in the natural source. Therefore, "isolated antibodies" and "purified antibodies" refer to antibodies that do not substantially include cell materials such as hydrocarbons, lipids, or other contaminant proteins from the cell or tissue source from which the antibodies (proteins) are derived. When the antibodies are chemically synthesized, the terms refer to antibodies that do not substantially include chemical precursor substances or other chemical substances. In a preferred embodiment, the antibodies of the present invention are isolated or purified.

"Antibodies" refers to glycoproteins that have the same structural characteristics. Antibodies show binding specificity towards specific antigens. Herein, "antigens" refers to proteins that have the ability to bind to the corresponding antibodies, and induce antigen-antibody reactions in vivo.

Herein, the antibody heavy chain may be denoted as "H chain", the antibody light chain may be denoted as "L chain", the heavy chain variable region may be denoted as "VH", the light chain variable region may be denoted as "VL", the heavy chain constant region may be denoted as "CH", the light chain constant region may be denoted as "CL", the framework region may be denoted as "FR", and the complementarity-determining region may be denoted as "CDR".

A beta proteins, which are the major constituents of amyloids, are peptides consisting of 40 to 42 amino acids, and are known to be produced from precursor proteins called amyloid precursor proteins (APPs) by the action of proteases. Besides amyloid fibrils collected in ultracentrifuged sediment fractions, the amyloid molecules produced from APPs include oligomeric non-fibrous assemblies in addition to soluble monomers. "A beta oligomers" of the present invention refer to non-fibrous assemblies. The degree of A beta polymerization of "A beta oligomer" of the present invention is not particularly limited, but is typically 2 to 150. The "A beta oligomers" of the present invention include, for example, A beta40 (A beta 1-40) oligomers, A beta42 (A beta 1-42) oligomers, and A beta40/A beta42 oligomers (in which A beta40 and A beta42 are polymerized). For example, "A beta oligomers" of the present invention are, typically, molecules showing a molecular weight of 45 to 160 kDa in SDS-PAGE, and 22.5 to 1,035 kDa in Blue Native PAGE. Using molecular sieves, the molecules are collected mainly in the >100 kDa retention solution. When observed under an atomic force microscope, the molecules show mixed morphologies of granular, bead-shaped, and ring-shaped molecules having a height of 1.5 to 3.1 nm.

There is no limitation on the origin and form of the antibodies used in the present invention as long as they bind to A beta oligomers but not to A beta monomers, or they bind to A beta oligomers but not to A beta monomers and amyloid precursor protein.

The antibodies of the present invention are featured by the characteristics that they bind to A beta oligomers but not to A beta monomers, or they bind to A beta oligomers but not to A beta monomers and amyloid precursor protein. Preferably, these antibodies have the following characteristics.

In dot-blot analysis, they react with A beta40 oligomers and A beta42 oligomers, but not with A beta40 monomers.

In competitive ELISA assay using immobilized A beta oligomers, the 50%-inhibition concentration (IC50) of A beta monomer for the binding of the antibodies to the immobilized A beta oligomers is higher than that of A beta oligomer.

In competitive ELISA assay using immobilized A beta oligomers, IC50 of A beta monomer is 500 nmol/L or more, preferably 1000 nmol/L or more, more preferably 1500 nmol/L or more, or more preferably 2000 nmol/L or more.

In competitive ELISA assay using immobilized A beta oligomers, IC50 of A beta oligomer is 100 nmol/L or less, preferably 50 nmol/L or less, more preferably 25 nmol/L or less, or more preferably 20 nmol/L or less.

In competitive ELISA assay using immobilized A beta oligomers, the antigen selectivity shown by IC50 of A beta monomer versus A beta oligomer for the binding of the antibodies to the immobilized A beta oligomers, i.e., IC50 of A beta monomer/IC50 of A beta oligomer, is 50 or more, preferably 100 or more, more preferably 150 or more, or more preferably 200 or more.

In the affinity analysis for A beta oligomers using Biacore (Biacore 3000), the binding rate constant (ka) is $1.0E+04$ $M^{-1}S^{-1}$ or more, preferably $2.0E+04$ $M^{-1}S^{-1}$ or more, more preferably $5.0E+04$ $M^{-1}S^{-1}$ or more, or more preferably $1.0E+05$ $M^{-1}S^{-1}$ or more.

In the affinity analysis for A beta oligomers using Biacore (Biacore 3000), the dissociation rate constant (kd) is $0.5$ $S^{-1}$ or less, preferably $0.2$ $S^{-1}$ or less, more preferably $0.1$ $S^{-1}$ or less, more preferably $0.05$ $S^{-1}$ or less, more preferably $0.01$ $S^{-1}$ or less, or more preferably $6.0E-03$ $S^{-1}$ or less.

In the affinity analysis for A beta oligomers using Biacore (Biacore 3000), the dissociation constant (KD) is $5.0E-06$ M or less, preferably $1.0E-06$ M or less, more preferably $7.0E-07$ M or less, more preferably $1.0E-07$ M or less, or more preferably $5.0E-08$ M or less.

In immunoblot analysis, they do not react with human amyloid precursor protein.

The antibodies of the present invention may be featured by at least one of the above characteristics. Furthermore, the antibodies may be featured by two or more of the above characteristics.

"Antibodies" of the present invention include both monoclonal and polyclonal antibodies. The antibodies of the present invention also include any type of antibodies such as non-human animal antibodies, humanized antibodies, chimeric antibodies, human antibodies, the later-described minibodies, amino acid sequence-modified antibodies, modified antibodies conjugated to other molecules (for example, polymers such as polyethylene glycol), and sugar chain-modified antibodies.

Herein, the term "monoclonal antibodies" refers to antibodies that are obtained from a substantially homogeneous population of antibodies. That is, the individual antibodies constituting the population are identical with the exception of possible natural mutants that may be present in a trace amount. Monoclonal antibodies are highly specific and recognize a single antigenic site. Each of the monoclonal antibodies recognizes a single determinant of the antigen, in contrast to conventional (polyclonal) antibody preparations that typically contain different antibodies against different antigenic determinants (epitopes).

In addition to the above-mentioned specificity, monoclonal antibodies have the advantage that they can be synthesized from a hybridoma culture that is not contaminated with other immunoglobulins. Therefore, "monoclonal" indicates the characteristics of antibodies that can be obtained from a substantially homogeneous antibody population. This term does not indicate the requirement for any specific method for antibody production.

Basically, monoclonal antibodies can be produced by using known techniques. For example, they may be produced by the hybridoma method first described by Kohler and Milstein (Nature 256: 495-7, 1975), or by the recombinant DNA method (Cabilly et al., Proc. Natl. Acad. Sci. USA 81:3273-7, 1984), but the methods are not limited thereto. For example, when using the hybridoma method, an A beta oligomer is used as a sensitizing antigen, and immunization is carried out according to a conventional immunization method. The obtained immune cells are fused with known parent cells by a conventional cell fusion method, and monoclonal antibody-producing cells can be screened and isolated using a conventional screening method.

The monoclonal antibodies of the present invention can be produced, for example, as follows. First, synthetic A beta 1-42 (Peptide Institute, Inc., Osaka) is dissolved in distilled deionized water or a 10 mM phosphate buffer solution, and this is incubated at 37 degrees C. for 18 hours. Then, the peptides are separated by 4-12% SDS-PAGE, and visualized by CBB staining, and the portion of the A beta 1-42 tetramer alone which is not contaminated with the A beta 1-42 monomer is cut out. Next, BALB/c mice are immunized at their foot pad with 2.5 micro g of the A beta 1-42 tetramer emulsified using complete Freund's adjuvant. Subsequently, booster immunizations are carried out six times. Hybridomas are produced from the inguinal lymph node by fusion with Sp2/O—Ag14 cells using Polyethylene Glycol 1500.

In the present invention, the animals immunized with sensitizing antigens are not particularly limited, but are preferably selected considering the compatibility with parent cells used for cell fusion. Generally, rodents, lagomorphs, or primates are used. Rodents include, for example, mice, rats, and hamsters. Lagomorphs include, for example, rabbits. Primates include, for example, Catarrhini (old-world) monkeys such as *Macaca fascicularis, Macaca mulatta*, hamadryas, and chimpanzees.

Animals are immunized with sensitizing antigens according to known methods. For example, as a standard method, immunization is performed by intraperitoneal or subcutaneous injection of a sensitizing antigen into mammals.

An example of the parent cells fused with the aforementioned immunocytes is the Sp2/O—Ag14 cell, which will be described below in the Examples. However, various other known cell lines can be used.

Cell fusion between the aforementioned immunocyte and a myeloma cell can be carried out basically according to known methods including the method by Kohler and Milstein (Kohler G. and Milstein C., Methods Enzymol. (1981) 73, 3-46).

Hybridomas obtained in this manner are selected by culturing them in a conventional selection culture medium such as a HAT culture medium, which contains hypoxanthine, aminopterin, and thymidine. Culturing in the above-mentioned HAT culture medium is generally continued for several days to several weeks for an adequate time for killing cells other than the desired hybridomas (non-fused cells). Next, a conventional limiting dilution method is performed for screening and singly-cloning of a hybridoma that produces the desired antibody.

Thereafter, the obtained hybridoma is transplanted into the abdominal cavity of a mouse, and ascitic fluid containing the desired monoclonal antibodies is extracted. For example, the antibodies can be purified from the ascitic fluid by conventional protein separation and/or purification methods such as a selected combination of column chromatography including, but not limited to, affinity chromatography, filtration, ultrafiltration, salt precipitation, dialysis, SDS polyacrylamide gel electrophoresis, and isoelectric focusing (Antibodies: A Laboratory manual, Harlow and David, Lane (edit.), Cold Spring Harbor Laboratory, 1988).

Protein A columns and Protein G columns can be used for affinity columns. Examples of the Protein A columns used include Hyper D, POROS, and Sepharose F.F. (Pharmacia).

Chromatography (excluding affinity chromatography) includes ion exchange chromatography, hydrophobic chromatography, gel filtration, reverse-phase chromatography, and adsorption chromatography ("Strategies for Protein Purification and Characterization: A Laboratory Course Manual", Daniel R Marshak et al., Cold Spring Harbor Laboratory Press, 1996). When chromatography is carried out, liquid-phase chromatography methods such as HPLC and FPLC can be used.

Monoclonal antibody-producing hybridomas prepared in this manner can be subcultured in a conventional culture medium, and they can be stored for a long time in liquid nitrogen.

Any mammal can be immunized using an immunogen for antibody production. However, when preparing monoclonal antibodies by producing hybridomas, the compatibility with parent cells used in cell fusion for hybridoma production is preferably considered.

Generally, rodents, lagomorphs, or primates are used for the immunization. Rodents include, for example, mice, rats, and hamsters. Lagomorphs include, for example, rabbits. Primates include, for example, Catarrhini (old-world) monkeys such as *Macaca fascicularis, Macaca mulatta*, hamadryas, and chimpanzees.

The use of transgenic animals that have a human antibody gene repertoire is known in the art (Ishida I, et al., Cloning and Stem Cells 4: 91-102, 2002). As with other animals, to obtain human monoclonal antibodies, the transgenic animals are immunized, then antibody-producing cells are collected from the animals and fused with myeloma cells to produce hybridomas, and anti-protein human antibodies can be prepared from these hybridomas (see International Publication Nos. WO92/03918, WO94/02602, WO94/25585, WO96/33735, and WO96/34096).

Alternatively, lymphocytes immortalized with oncogenes may be used for monoclonal antibody production. For example, human lymphocytes infected with EB virus or such is immunized in vitro with immunogens. Next, the immunized lymphocytes are fused with human-derived myeloma cells (U266, etc) capable of unlimited division, and thus hybridomas that produce the desired human antibodies are obtained (Japanese Patent Application Kokai Publication No. (JP-A) S63-17688 (unexamined, published Japanese patent application)).

Once monoclonal antibodies can be obtained by any of the aforementioned methods, the antibodies may also be prepared using genetic engineering methods (see, for example, Borrebaeck C A K and Larrick J W, Therapeutic Monoclonal Antibodies, MacMillan Publishers, UK, 1990). For example, recombinant antibodies may be prepared by cloning DNAs that encode the desired antibodies from antibody-producing cells such as hybridomas or immunized lymphocytes that produce the antibodies, then inserting the cloned DNAs into appropriate vectors, and transfecting the vectors into suitable host cells. Such recombinant antibodies are also included in the present invention.

Examples of the monoclonal antibodies of the present invention include the following:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies.

For the IR-001 antibody of the present invention:

the amino acid sequence and the nucleotide sequence of the H-chain variable region (VH) are shown in SEQ ID NOs: 2290 and 2289, respectively;

the amino acid sequence and the nucleotide sequence of the L-chain variable region (VL) are shown in SEQ ID NOs: 2292 and 2291, respectively;

the amino acid sequence and the nucleotide sequence of the H-chain CDR1 are shown in SEQ ID NOs: 6 and 5, respectively;

the amino acid sequence and the nucleotide sequence of the H-chain CDR2 are shown in SEQ ID NOs: 8 and 7, respectively;

the amino acid sequence and the nucleotide sequence of the H-chain CDR3 are shown in SEQ ID NOs: 10 and 9, respectively;

the amino acid sequence and the nucleotide sequence of the L-chain CDR1 are shown in SEQ ID NOs: 12 and 11, respectively;

the amino acid sequence and the nucleotide sequence of the L-chain CDR2 are shown in SEQ ID NOs: 14 and 13, respectively;

the amino acid sequence and the nucleotide sequence of the L-chain CDR3 are shown in SEQ ID NOs: 16 and 15, respectively.

For the IR-002 antibody of the present invention:

the amino acid sequence and the nucleotide sequence of the H-chain variable region (VH) are shown in SEQ ID NOs: 2294 and 2293, respectively;

the amino acid sequence and the nucleotide sequence of the L-chain variable region (VL) are shown in SEQ ID NOs: 2296 and 2295, respectively;

the amino acid sequence and the nucleotide sequence of the H-chain CDR1 are shown in SEQ ID NOs: 22 and 21, respectively;

the amino acid sequence and the nucleotide sequence of the H-chain CDR2 are shown in SEQ ID NOs: 24 and 23, respectively;

the amino acid sequence and the nucleotide sequence of the H-chain CDR3 are shown in SEQ ID NOs: 26 and 25, respectively;

the amino acid sequence and the nucleotide sequence of the L-chain CDR1 are shown in SEQ ID NOs: 28 and 27, respectively;

the amino acid sequence and the nucleotide sequence of the L-chain CDR2 are shown in SEQ ID NOs: 30 and 29, respectively;

the amino acid sequence and the nucleotide sequence of the L-chain CDR3 are shown in SEQ ID NOs: 32 and 31, respectively.

For the IR-004 antibody of the present invention:

the amino acid sequence and the nucleotide sequence of the H-chain variable region (VH) are shown in SEQ ID NOs: 2298 and 2297, respectively;

the amino acid sequence and the nucleotide sequence of the L-chain variable region (VL) are shown in SEQ ID NOs: 2300 and 2299, respectively;

the amino acid sequence and the nucleotide sequence of the H-chain CDR1 are shown in SEQ ID NOs: 38 and 37, respectively;

the amino acid sequence and the nucleotide sequence of the H-chain CDR2 are shown in SEQ ID NOs: 40 and 39, respectively;

the amino acid sequence and the nucleotide sequence of the H-chain CDR3 are shown in SEQ ID NOs: 42 and 41, respectively;

the amino acid sequence and the nucleotide sequence of the L-chain CDR1 are shown in SEQ ID NOs: 44 and 43, respectively;

the amino acid sequence and the nucleotide sequence of the L-chain CDR2 are shown in SEQ ID NOs: 46 and 45, respectively;

the amino acid sequence and the nucleotide sequence of the L-chain CDR3 are shown in SEQ ID NOs: 48 and 47, respectively.

For the IR-005 antibody of the present invention:

the amino acid sequence and the nucleotide sequence of the H-chain variable region (VH) are shown in SEQ ID NOs: 2302 and 2301, respectively;

the amino acid sequence and the nucleotide sequence of the L-chain variable region (VL) are shown in SEQ ID NOs: 2304 and 2303, respectively;

the amino acid sequence and the nucleotide sequence of the H-chain CDR1 are shown in SEQ ID NOs: 54 and 53, respectively;

the amino acid sequence and the nucleotide sequence of the H-chain CDR2 are shown in SEQ ID NOs: 56 and 55, respectively;

the amino acid sequence and the nucleotide sequence of the H-chain CDR3 are shown in SEQ ID NOs: 58 and 57, respectively;

the amino acid sequence and the nucleotide sequence of the L-chain CDR1 are shown in SEQ ID NOs: 60 and 59, respectively;

the amino acid sequence and the nucleotide sequence of the L-chain CDR2 are shown in SEQ ID NOs: 62 and 61, respectively;

the amino acid sequence and the nucleotide sequence of the L-chain CDR3 are shown in SEQ ID NOs: 64 and 63, respectively.

For the IR-006 antibody of the present invention:

the amino acid sequence and the nucleotide sequence of the H-chain variable region (VH) are shown in SEQ ID NOs: 2306 and 2305, respectively;

the amino acid sequence and the nucleotide sequence of the L-chain variable region (VL) are shown in SEQ ID NOs: 2308 and 2307, respectively;

the amino acid sequence and the nucleotide sequence of the H-chain CDR1 are shown in SEQ ID NOs: 70 and 69, respectively;

the amino acid sequence and the nucleotide sequence of the H-chain CDR2 are shown in SEQ ID NOs: 72 and 71, respectively;

the amino acid sequence and the nucleotide sequence of the H-chain CDR3 are shown in SEQ ID NOs: 74 and 73, respectively;

the amino acid sequence and the nucleotide sequence of the L-chain CDR1 are shown in SEQ ID NOs: 76 and 75, respectively;

the amino acid sequence and the nucleotide sequence of the L-chain CDR2 are shown in SEQ ID NOs: 78 and 77, respectively;

the amino acid sequence and the nucleotide sequence of the L-chain CDR3 are shown in SEQ ID NOs: 80 and 79, respectively.

For the IR-007 antibody of the present invention:

the amino acid sequence and the nucleotide sequence of the H-chain variable region (VH) are shown in SEQ ID NOs: 2310 and 2309, respectively;

the amino acid sequence and the nucleotide sequence of the L-chain variable region (VL) are shown in SEQ ID NOs: 2312 and 2311, respectively;

the amino acid sequence and the nucleotide sequence of the H-chain CDR1 are shown in SEQ ID NOs: 86 and 85, respectively;

the amino acid sequence and the nucleotide sequence of the H-chain CDR2 are shown in SEQ ID NOs: 88 and 87, respectively;

the amino acid sequence and the nucleotide sequence of the H-chain CDR3 are shown in SEQ ID NOs: 90 and 89, respectively;

the amino acid sequence and the nucleotide sequence of the L-chain CDR1 are shown in SEQ ID NOs: 92 and 91, respectively;

the amino acid sequence and the nucleotide sequence of the L-chain CDR2 are shown in SEQ ID NOs: 94 and 93, respectively;

the amino acid sequence and the nucleotide sequence of the L-chain CDR3 are shown in SEQ ID NOs: 96 and 95, respectively.

For the IR-008 antibody of the present invention:

the amino acid sequence and the nucleotide sequence of the H-chain variable region (VH) are shown in SEQ ID NOs: 2314 and 2313, respectively;

the amino acid sequence and the nucleotide sequence of the L-chain variable region (VL) are shown in SEQ ID NOs: 2316 and 2315, respectively;

the amino acid sequence and the nucleotide sequence of the H-chain CDR1 are shown in SEQ ID NOs: 102 and 101, respectively;

the amino acid sequence and the nucleotide sequence of the H-chain CDR2 are shown in SEQ ID NOs: 104 and 103, respectively;

the amino acid sequence and the nucleotide sequence of the H-chain CDR3 are shown in SEQ ID NOs: 106 and 105, respectively;

the amino acid sequence and the nucleotide sequence of the L-chain CDR1 are shown in SEQ ID NOs: 108 and 107, respectively;

the amino acid sequence and the nucleotide sequence of the L-chain CDR2 are shown in SEQ ID NOs: 110 and 109, respectively;

the amino acid sequence and the nucleotide sequence of the L-chain CDR3 are shown in SEQ ID NOs: 112 and 111, respectively.

For the IR-011 antibody of the present invention:

the amino acid sequence and the nucleotide sequence of the H-chain variable region (VH) are shown in SEQ ID NOs: 2318 and 2317, respectively;

the amino acid sequence and the nucleotide sequence of the L-chain variable region (VL) are shown in SEQ ID NOs: 2320 and 2319, respectively;

the amino acid sequence and the nucleotide sequence of the H-chain CDR1 are shown in SEQ ID NOs: 118 and 117, respectively;

the amino acid sequence and the nucleotide sequence of the H-chain CDR2 are shown in SEQ ID NOs: 120 and 119, respectively;

the amino acid sequence and the nucleotide sequence of the H-chain CDR3 are shown in SEQ ID NOs: 122 and 121, respectively;

the amino acid sequence and the nucleotide sequence of the L-chain CDR1 are shown in SEQ ID NOs: 124 and 123, respectively;

the amino acid sequence and the nucleotide sequence of the L-chain CDR2 are shown in SEQ ID NOs: 126 and 125, respectively;

the amino acid sequence and the nucleotide sequence of the L-chain CDR3 are shown in SEQ ID NOs: 128 and 127, respectively.

For the IR-012 antibody of the present invention:

the amino acid sequence and the nucleotide sequence of the H-chain variable region (VH) are shown in SEQ ID NOs: 2322 and 2321, respectively;

the amino acid sequence and the nucleotide sequence of the L-chain variable region (VL) are shown in SEQ ID NOs: 2324 and 2323, respectively;

the amino acid sequence and the nucleotide sequence of the H-chain CDR1 are shown in SEQ ID NOs: 134 and 133, respectively;

the amino acid sequence and the nucleotide sequence of the H-chain CDR2 are shown in SEQ ID NOs: 136 and 135, respectively;

the amino acid sequence and the nucleotide sequence of the H-chain CDR3 are shown in SEQ ID NOs: 138 and 137, respectively;

the amino acid sequence and the nucleotide sequence of the L-chain CDR1 are shown in SEQ ID NOs: 140 and 139, respectively;

the amino acid sequence and the nucleotide sequence of the L-chain CDR2 are shown in SEQ ID NOs: 142 and 141, respectively;

the amino acid sequence and the nucleotide sequence of the L-chain CDR3 are shown in SEQ ID NOs: 144 and 143, respectively.

For the IR-013 antibody of the present invention:

the amino acid sequence and the nucleotide sequence of the H-chain variable region (VH) are shown in SEQ ID NOs: 2326 and 2325, respectively;

the amino acid sequence and the nucleotide sequence of the L-chain variable region (VL) are shown in SEQ ID NOs: 2328 and 2327, respectively;

the amino acid sequence and the nucleotide sequence of the H-chain CDR1 are shown in SEQ ID NOs: 150 and 149, respectively;

the amino acid sequence and the nucleotide sequence of the H-chain CDR2 are shown in SEQ ID NOs: 152 and 151, respectively;

the amino acid sequence and the nucleotide sequence of the H-chain CDR3 are shown in SEQ ID NOs: 154 and 153, respectively;

the amino acid sequence and the nucleotide sequence of the L-chain CDR1 are shown in SEQ ID NOs: 156 and 155, respectively;

the amino acid sequence and the nucleotide sequence of the L-chain CDR2 are shown in SEQ ID NOs: 158 and 157, respectively;

the amino acid sequence and the nucleotide sequence of the L-chain CDR3 are shown in SEQ ID NOs: 160 and 159, respectively.

For the IR-014 antibody of the present invention:

the amino acid sequence and the nucleotide sequence of the H-chain variable region (VH) are shown in SEQ ID NOs: 2330 and 2329, respectively;

the amino acid sequence and the nucleotide sequence of the L-chain variable region (VL) are shown in SEQ ID NOs: 2332 and 2331, respectively;

the amino acid sequence and the nucleotide sequence of the H-chain CDR1 are shown in SEQ ID NOs: 166 and 165, respectively;

the amino acid sequence and the nucleotide sequence of the H-chain CDR2 are shown in SEQ ID NOs: 168 and 167, respectively;

the amino acid sequence and the nucleotide sequence of the H-chain CDR3 are shown in SEQ ID NOs: 170 and 169, respectively;

the amino acid sequence and the nucleotide sequence of the L-chain CDR1 are shown in SEQ ID NOs: 172 and 171, respectively;

the amino acid sequence and the nucleotide sequence of the L-chain CDR2 are shown in SEQ ID NOs: 174 and 173, respectively;

the amino acid sequence and the nucleotide sequence of the L-chain CDR3 are shown in SEQ ID NOs: 176 and 175, respectively.

For the IR-015 antibody of the present invention:

the amino acid sequence and the nucleotide sequence of the H-chain variable region (VH) are shown in SEQ ID NOs: 2334 and 2333, respectively;

the amino acid sequence and the nucleotide sequence of the L-chain variable region (VL) are shown in SEQ ID NOs: 2336 and 2335, respectively;

the amino acid sequence and the nucleotide sequence of the H-chain CDR1 are shown in SEQ ID NOs: 182 and 181, respectively;

the amino acid sequence and the nucleotide sequence of the H-chain CDR2 are shown in SEQ ID NOs: 184 and 183, respectively;

the amino acid sequence and the nucleotide sequence of the H-chain CDR3 are shown in SEQ ID NOs: 186 and 185, respectively;

the amino acid sequence and the nucleotide sequence of the L-chain CDR1 are shown in SEQ ID NOs: 188 and 187, respectively;

the amino acid sequence and the nucleotide sequence of the L-chain CDR2 are shown in SEQ ID NOs: 190 and 189, respectively;

the amino acid sequence and the nucleotide sequence of the L-chain CDR3 are shown in SEQ ID NOs: 192 and 191, respectively.

For the IR-017 antibody of the present invention:
the amino acid sequence and the nucleotide sequence of the H-chain variable region (VH) are shown in SEQ ID NOs: 2338 and 2337, respectively;
the amino acid sequence and the nucleotide sequence of the L-chain variable region (VL) are shown in SEQ ID NOs: 2340 and 2339, respectively;
the amino acid sequence and the nucleotide sequence of the H-chain CDR1 are shown in SEQ ID NOs: 198 and 197, respectively;
the amino acid sequence and the nucleotide sequence of the H-chain CDR2 are shown in SEQ ID NOs: 200 and 199, respectively;
the amino acid sequence and the nucleotide sequence of the H-chain CDR3 are shown in SEQ ID NOs: 202 and 201, respectively;
the amino acid sequence and the nucleotide sequence of the L-chain CDR1 are shown in SEQ ID NOs: 204 and 203, respectively;
the amino acid sequence and the nucleotide sequence of the L-chain CDR2 are shown in SEQ ID NOs: 206 and 205, respectively;
the amino acid sequence and the nucleotide sequence of the L-chain CDR3 are shown in SEQ ID NOs: 208 and 207, respectively.

For the IR-020 antibody of the present invention:
the amino acid sequence and the nucleotide sequence of the H-chain variable region (VH) are shown in SEQ ID NOs: 2342 and 2341, respectively;
the amino acid sequence and the nucleotide sequence of the L-chain variable region (VL) are shown in SEQ ID NOs: 2344 and 2343, respectively;
the amino acid sequence and the nucleotide sequence of the H-chain CDR1 are shown in SEQ ID NOs: 214 and 213, respectively;
the amino acid sequence and the nucleotide sequence of the H-chain CDR2 are shown in SEQ ID NOs: 216 and 215, respectively;
the amino acid sequence and the nucleotide sequence of the H-chain CDR3 are shown in SEQ ID NOs: 218 and 217, respectively;
the amino acid sequence and the nucleotide sequence of the L-chain CDR1 are shown in SEQ ID NOs: 220 and 219, respectively;
the amino acid sequence and the nucleotide sequence of the L-chain CDR2 are shown in SEQ ID NOs: 222 and 221, respectively;
the amino acid sequence and the nucleotide sequence of the L-chain CDR3 are shown in SEQ ID NOs: 224 and 223, respectively.

For the IR-021 antibody of the present invention:
the amino acid sequence and the nucleotide sequence of the H-chain variable region (VH) are shown in SEQ ID NOs: 2346 and 2345, respectively;
the amino acid sequence and the nucleotide sequence of the L-chain variable region (VL) are shown in SEQ ID NOs: 2348 and 2347, respectively;
the amino acid sequence and the nucleotide sequence of the H-chain CDR1 are shown in SEQ ID NOs: 230 and 229, respectively;
the amino acid sequence and the nucleotide sequence of the H-chain CDR2 are shown in SEQ ID NOs: 232 and 231, respectively;
the amino acid sequence and the nucleotide sequence of the H-chain CDR3 are shown in SEQ ID NOs: 234 and 233, respectively;
the amino acid sequence and the nucleotide sequence of the L-chain CDR1 are shown in SEQ ID NOs: 236 and 235, respectively;
the amino acid sequence and the nucleotide sequence of the L-chain CDR2 are shown in SEQ ID NOs: 238 and 237, respectively;
the amino acid sequence and the nucleotide sequence of the L-chain CDR3 are shown in SEQ ID NOs: 240 and 239, respectively.

For the IR-022 antibody of the present invention:
the amino acid sequence and the nucleotide sequence of the H-chain variable region (VH) are shown in SEQ ID NOs: 2350 and 2349, respectively;
the amino acid sequence and the nucleotide sequence of the L-chain variable region (VL) are shown in SEQ ID NOs: 2352 and 2351, respectively;
the amino acid sequence and the nucleotide sequence of the H-chain CDR1 are shown in SEQ ID NOs: 246 and 245, respectively;
the amino acid sequence and the nucleotide sequence of the H-chain CDR2 are shown in SEQ ID NOs: 248 and 247, respectively;
the amino acid sequence and the nucleotide sequence of the H-chain CDR3 are shown in SEQ ID NOs: 250 and 249, respectively;
the amino acid sequence and the nucleotide sequence of the L-chain CDR1 are shown in SEQ ID NOs: 252 and 251, respectively;
the amino acid sequence and the nucleotide sequence of the L-chain CDR2 are shown in SEQ ID NOs: 254 and 253, respectively;
the amino acid sequence and the nucleotide sequence of the L-chain CDR3 are shown in SEQ ID NOs: 256 and 255, respectively.

For the IR-023 antibody of the present invention:
the amino acid sequence and the nucleotide sequence of the H-chain variable region (VH) are shown in SEQ ID NOs: 2354 and 2353, respectively;
the amino acid sequence and the nucleotide sequence of the L-chain variable region (VL) are shown in SEQ ID NOs: 2356 and 2355, respectively;
the amino acid sequence and the nucleotide sequence of the H-chain CDR1 are shown in SEQ ID NOs: 262 and 261, respectively;
the amino acid sequence and the nucleotide sequence of the H-chain CDR2 are shown in SEQ ID NOs: 264 and 263, respectively;
the amino acid sequence and the nucleotide sequence of the H-chain CDR3 are shown in SEQ ID NOs: 266 and 265, respectively;
the amino acid sequence and the nucleotide sequence of the L-chain CDR1 are shown in SEQ ID NOs: 268 and 267, respectively;
the amino acid sequence and the nucleotide sequence of the L-chain CDR2 are shown in SEQ ID NOs: 270 and 269, respectively;
the amino acid sequence and the nucleotide sequence of the L-chain CDR3 are shown in SEQ ID NOs: 272 and 271, respectively.

For the IR-024 antibody of the present invention:
the amino acid sequence and the nucleotide sequence of the H-chain variable region (VH) are shown in SEQ ID NOs: 2358 and 2357, respectively;

the amino acid sequence and the nucleotide sequence of the L-chain variable region (VL) are shown in SEQ ID NOs: 2360 and 2359, respectively;

the amino acid sequence and the nucleotide sequence of the H-chain CDR1 are shown in SEQ ID NOs: 278 and 277, respectively;

the amino acid sequence and the nucleotide sequence of the H-chain CDR2 are shown in SEQ ID NOs: 280 and 279, respectively;

the amino acid sequence and the nucleotide sequence of the H-chain CDR3 are shown in SEQ ID NOs: 282 and 281, respectively;

the amino acid sequence and the nucleotide sequence of the L-chain CDR1 are shown in SEQ ID NOs: 284 and 283, respectively;

the amino acid sequence and the nucleotide sequence of the L-chain CDR2 are shown in SEQ ID NOs: 286 and 285, respectively;

the amino acid sequence and the nucleotide sequence of the L-chain CDR3 are shown in SEQ ID NOs: 288 and 287, respectively.

For the IR-025 antibody of the present invention:

the amino acid sequence and the nucleotide sequence of the H-chain variable region (VH) are shown in SEQ ID NOs: 2362 and 2361, respectively;

the amino acid sequence and the nucleotide sequence of the L-chain variable region (VL) are shown in SEQ ID NOs: 2364 and 2363, respectively;

the amino acid sequence and the nucleotide sequence of the H-chain CDR1 are shown in SEQ ID NOs: 294 and 293, respectively;

the amino acid sequence and the nucleotide sequence of the H-chain CDR2 are shown in SEQ ID NOs: 296 and 295, respectively;

the amino acid sequence and the nucleotide sequence of the H-chain CDR3 are shown in SEQ ID NOs: 298 and 297, respectively;

the amino acid sequence and the nucleotide sequence of the L-chain CDR1 are shown in SEQ ID NOs: 300 and 299, respectively;

the amino acid sequence and the nucleotide sequence of the L-chain CDR2 are shown in SEQ ID NOs: 302 and 301, respectively;

the amino acid sequence and the nucleotide sequence of the L-chain CDR3 are shown in SEQ ID NOs: 304 and 303, respectively.

For the IR-026 antibody of the present invention:

the amino acid sequence and the nucleotide sequence of the H-chain variable region (VH) are shown in SEQ ID NOs: 2366 and 2365, respectively;

the amino acid sequence and the nucleotide sequence of the L-chain variable region (VL) are shown in SEQ ID NOs: 2368 and 2367, respectively;

the amino acid sequence and the nucleotide sequence of the H-chain CDR1 are shown in SEQ ID NOs: 310 and 309, respectively;

the amino acid sequence and the nucleotide sequence of the H-chain CDR2 are shown in SEQ ID NOs: 312 and 311, respectively;

the amino acid sequence and the nucleotide sequence of the H-chain CDR3 are shown in SEQ ID NOs: 314 and 313, respectively;

the amino acid sequence and the nucleotide sequence of the L-chain CDR1 are shown in SEQ ID NOs: 316 and 315, respectively;

the amino acid sequence and the nucleotide sequence of the L-chain CDR2 are shown in SEQ ID NOs: 318 and 317, respectively;

the amino acid sequence and the nucleotide sequence of the L-chain CDR3 are shown in SEQ ID NOs: 320 and 319, respectively.

For the IR-027 antibody of the present invention:

the amino acid sequence and the nucleotide sequence of the H-chain variable region (VH) are shown in SEQ ID NOs: 2370 and 2369, respectively;

the amino acid sequence and the nucleotide sequence of the L-chain variable region (VL) are shown in SEQ ID NOs: 2372 and 2371, respectively;

the amino acid sequence and the nucleotide sequence of the H-chain CDR1 are shown in SEQ ID NOs: 326 and 325, respectively;

the amino acid sequence and the nucleotide sequence of the H-chain CDR2 are shown in SEQ ID NOs: 328 and 327, respectively;

the amino acid sequence and the nucleotide sequence of the H-chain CDR3 are shown in SEQ ID NOs: 330 and 329, respectively;

the amino acid sequence and the nucleotide sequence of the L-chain CDR1 are shown in SEQ ID NOs: 332 and 331, respectively;

the amino acid sequence and the nucleotide sequence of the L-chain CDR2 are shown in SEQ ID NOs: 334 and 333, respectively;

the amino acid sequence and the nucleotide sequence of the L-chain CDR3 are shown in SEQ ID NOs: 336 and 335, respectively.

For the IR-028 antibody of the present invention:

the amino acid sequence and the nucleotide sequence of the H-chain variable region (VH) are shown in SEQ ID NOs: 2374 and 2373, respectively;

the amino acid sequence and the nucleotide sequence of the L-chain variable region (VL) are shown in SEQ ID NOs: 2376 and 2375, respectively;

the amino acid sequence and the nucleotide sequence of the H-chain CDR1 are shown in SEQ ID NOs: 342 and 341, respectively;

the amino acid sequence and the nucleotide sequence of the H-chain CDR2 are shown in SEQ ID NOs: 344 and 343, respectively;

the amino acid sequence and the nucleotide sequence of the H-chain CDR3 are shown in SEQ ID NOs: 346 and 345, respectively;

the amino acid sequence and the nucleotide sequence of the L-chain CDR1 are shown in SEQ ID NOs: 348 and 347, respectively;

the amino acid sequence and the nucleotide sequence of the L-chain CDR2 are shown in SEQ ID NOs: 350 and 349, respectively;

the amino acid sequence and the nucleotide sequence of the L-chain CDR3 are shown in SEQ ID NOs: 352 and 351, respectively.

For the IR-029 antibody of the present invention:

the amino acid sequence and the nucleotide sequence of the H-chain variable region (VH) are shown in SEQ ID NOs: 2378 and 2377, respectively;

the amino acid sequence and the nucleotide sequence of the L-chain variable region (VL) are shown in SEQ ID NOs: 2380 and 2379, respectively;

the amino acid sequence and the nucleotide sequence of the H-chain CDR1 are shown in SEQ ID NOs: 358 and 357, respectively;

the amino acid sequence and the nucleotide sequence of the H-chain CDR2 are shown in SEQ ID NOs: 360 and 359, respectively;

the amino acid sequence and the nucleotide sequence of the H-chain CDR3 are shown in SEQ ID NOs: 362 and 361, respectively;

the amino acid sequence and the nucleotide sequence of the L-chain CDR1 are shown in SEQ ID NOs: 364 and 363, respectively;

the amino acid sequence and the nucleotide sequence of the L-chain CDR2 are shown in SEQ ID NOs: 366 and 365, respectively;

the amino acid sequence and the nucleotide sequence of the L-chain CDR3 are shown in SEQ ID NOs: 368 and 367, respectively.

For the IR-030 antibody of the present invention:
the amino acid sequence and the nucleotide sequence of the H-chain variable region (VH) are shown in SEQ ID NOs: 2382 and 2381, respectively;

the amino acid sequence and the nucleotide sequence of the L-chain variable region (VL) are shown in SEQ ID NOs: 2384 and 2383, respectively;

the amino acid sequence and the nucleotide sequence of the H-chain CDR1 are shown in SEQ ID NOs: 374 and 373, respectively;

the amino acid sequence and the nucleotide sequence of the H-chain CDR2 are shown in SEQ ID NOs: 376 and 375, respectively;

the amino acid sequence and the nucleotide sequence of the H-chain CDR3 are shown in SEQ ID NOs: 378 and 377, respectively;

the amino acid sequence and the nucleotide sequence of the L-chain CDR1 are shown in SEQ ID NOs: 380 and 379, respectively;

the amino acid sequence and the nucleotide sequence of the L-chain CDR2 are shown in SEQ ID NOs: 382 and 381, respectively;

the amino acid sequence and the nucleotide sequence of the L-chain CDR3 are shown in SEQ ID NOs: 384 and 383, respectively.

For the IR-031 antibody of the present invention:
the amino acid sequence and the nucleotide sequence of the H-chain variable region (VH) are shown in SEQ ID NOs: 2386 and 2385, respectively;

the amino acid sequence and the nucleotide sequence of the L-chain variable region (VL) are shown in SEQ ID NOs: 2388 and 2387, respectively;

the amino acid sequence and the nucleotide sequence of the H-chain CDR1 are shown in SEQ ID NOs: 390 and 389, respectively;

the amino acid sequence and the nucleotide sequence of the H-chain CDR2 are shown in SEQ ID NOs: 392 and 391, respectively;

the amino acid sequence and the nucleotide sequence of the H-chain CDR3 are shown in SEQ ID NOs: 394 and 393, respectively;

the amino acid sequence and the nucleotide sequence of the L-chain CDR1 are shown in SEQ ID NOs: 396 and 395, respectively;

the amino acid sequence and the nucleotide sequence of the L-chain CDR2 are shown in SEQ ID NOs: 398 and 397, respectively;

the amino acid sequence and the nucleotide sequence of the L-chain CDR3 are shown in SEQ ID NOs: 400 and 399, respectively.

For the IR-032 antibody of the present invention:
the amino acid sequence and the nucleotide sequence of the H-chain variable region (VH) are shown in SEQ ID NOs: 2390 and 2389, respectively;

the amino acid sequence and the nucleotide sequence of the L-chain variable region (VL) are shown in SEQ ID NOs: 2392 and 2391, respectively;

the amino acid sequence and the nucleotide sequence of the H-chain CDR1 are shown in SEQ ID NOs: 406 and 405, respectively;

the amino acid sequence and the nucleotide sequence of the H-chain CDR2 are shown in SEQ ID NOs: 408 and 407, respectively;

the amino acid sequence and the nucleotide sequence of the H-chain CDR3 are shown in SEQ ID NOs: 410 and 409, respectively;

the amino acid sequence and the nucleotide sequence of the L-chain CDR1 are shown in SEQ ID NOs: 412 and 411, respectively;

the amino acid sequence and the nucleotide sequence of the L-chain CDR2 are shown in SEQ ID NOs: 414 and 413, respectively;

the amino acid sequence and the nucleotide sequence of the L-chain CDR3 are shown in SEQ ID NOs: 416 and 415, respectively.

For the IR-033 antibody of the present invention:
the amino acid sequence and the nucleotide sequence of the H-chain variable region (VH) are shown in SEQ ID NOs: 2394 and 2393, respectively;

the amino acid sequence and the nucleotide sequence of the L-chain variable region (VL) are shown in SEQ ID NOs: 2396 and 2395, respectively;

the amino acid sequence and the nucleotide sequence of the H-chain CDR1 are shown in SEQ ID NOs: 422 and 421, respectively;

the amino acid sequence and the nucleotide sequence of the H-chain CDR2 are shown in SEQ ID NOs: 424 and 423, respectively;

the amino acid sequence and the nucleotide sequence of the H-chain CDR3 are shown in SEQ ID NOs: 426 and 425, respectively;

the amino acid sequence and the nucleotide sequence of the L-chain CDR1 are shown in SEQ ID NOs: 428 and 427, respectively;

the amino acid sequence and the nucleotide sequence of the L-chain CDR2 are shown in SEQ ID NOs: 430 and 429, respectively;

the amino acid sequence and the nucleotide sequence of the L-chain CDR3 are shown in SEQ ID NOs: 432 and 431, respectively.

For the IR-034 antibody of the present invention:
the amino acid sequence and the nucleotide sequence of the H-chain variable region (VH) are shown in SEQ ID NOs: 2398 and 2397, respectively;

the amino acid sequence and the nucleotide sequence of the L-chain variable region (VL) are shown in SEQ ID NOs: 2400 and 2399, respectively;

the amino acid sequence and the nucleotide sequence of the H-chain CDR1 are shown in SEQ ID NOs: 438 and 437, respectively;

the amino acid sequence and the nucleotide sequence of the H-chain CDR2 are shown in SEQ ID NOs: 440 and 439, respectively;

the amino acid sequence and the nucleotide sequence of the H-chain CDR3 are shown in SEQ ID NOs: 442 and 441, respectively;

the amino acid sequence and the nucleotide sequence of the L-chain CDR1 are shown in SEQ ID NOs: 444 and 443, respectively;

the amino acid sequence and the nucleotide sequence of the L-chain CDR2 are shown in SEQ ID NOs: 446 and 445, respectively;

the amino acid sequence and the nucleotide sequence of the L-chain CDR3 are shown in SEQ ID NOs: 448 and 447, respectively.

For the IR-035 antibody of the present invention:

the amino acid sequence and the nucleotide sequence of the H-chain variable region (VH) are shown in SEQ ID NOs: 2402 and 2401, respectively;

the amino acid sequence and the nucleotide sequence of the L-chain variable region (VL) are shown in SEQ ID NOs: 2404 and 2403, respectively;

the amino acid sequence and the nucleotide sequence of the H-chain CDR1 are shown in SEQ ID NOs: 454 and 453, respectively;

the amino acid sequence and the nucleotide sequence of the H-chain CDR2 are shown in SEQ ID NOs: 456 and 455, respectively;

the amino acid sequence and the nucleotide sequence of the H-chain CDR3 are shown in SEQ ID NOs: 458 and 457, respectively;

the amino acid sequence and the nucleotide sequence of the L-chain CDR1 are shown in SEQ ID NOs: 460 and 459, respectively;

the amino acid sequence and the nucleotide sequence of the L-chain CDR2 are shown in SEQ ID NOs: 462 and 461, respectively;

the amino acid sequence and the nucleotide sequence of the L-chain CDR3 are shown in SEQ ID NOs: 464 and 463, respectively.

For the IR-036 antibody of the present invention:

the amino acid sequence and the nucleotide sequence of the H-chain variable region (VH) are shown in SEQ ID NOs: 2406 and 2405, respectively;

the amino acid sequence and the nucleotide sequence of the L-chain variable region (VL) are shown in SEQ ID NOs: 2408 and 2407, respectively;

the amino acid sequence and the nucleotide sequence of the H-chain CDR1 are shown in SEQ ID NOs: 470 and 469, respectively;

the amino acid sequence and the nucleotide sequence of the H-chain CDR2 are shown in SEQ ID NOs: 472 and 471, respectively;

the amino acid sequence and the nucleotide sequence of the H-chain CDR3 are shown in SEQ ID NOs: 474 and 473, respectively;

the amino acid sequence and the nucleotide sequence of the L-chain CDR1 are shown in SEQ ID NOs: 476 and 475, respectively;

the amino acid sequence and the nucleotide sequence of the L-chain CDR2 are shown in SEQ ID NOs: 478 and 477, respectively;

the amino acid sequence and the nucleotide sequence of the L-chain CDR3 are shown in SEQ ID NOs: 480 and 479, respectively.

For the IR-037 antibody of the present invention:

the amino acid sequence and the nucleotide sequence of the H-chain variable region (VH) are shown in SEQ ID NOs: 2410 and 2409, respectively;

the amino acid sequence and the nucleotide sequence of the L-chain variable region (VL) are shown in SEQ ID NOs: 2412 and 2411, respectively;

the amino acid sequence and the nucleotide sequence of the H-chain CDR1 are shown in SEQ ID NOs: 486 and 485, respectively;

the amino acid sequence and the nucleotide sequence of the H-chain CDR2 are shown in SEQ ID NOs: 488 and 487, respectively;

the amino acid sequence and the nucleotide sequence of the H-chain CDR3 are shown in SEQ ID NOs: 490 and 489, respectively;

the amino acid sequence and the nucleotide sequence of the L-chain CDR1 are shown in SEQ ID NOs: 492 and 491, respectively;

the amino acid sequence and the nucleotide sequence of the L-chain CDR2 are shown in SEQ ID NOs: 494 and 493, respectively;

the amino acid sequence and the nucleotide sequence of the L-chain CDR3 are shown in SEQ ID NOs: 496 and 495, respectively.

For the IR-038 antibody of the present invention:

the amino acid sequence and the nucleotide sequence of the H-chain variable region (VH) are shown in SEQ ID NOs: 2414 and 2413, respectively;

the amino acid sequence and the nucleotide sequence of the L-chain variable region (VL) are shown in SEQ ID NOs: 2416 and 2415, respectively;

the amino acid sequence and the nucleotide sequence of the H-chain CDR1 are shown in SEQ ID NOs: 502 and 501, respectively;

the amino acid sequence and the nucleotide sequence of the H-chain CDR2 are shown in SEQ ID NOs: 504 and 503, respectively;

the amino acid sequence and the nucleotide sequence of the H-chain CDR3 are shown in SEQ ID NOs: 506 and 505, respectively;

the amino acid sequence and the nucleotide sequence of the L-chain CDR1 are shown in SEQ ID NOs: 508 and 507, respectively;

the amino acid sequence and the nucleotide sequence of the L-chain CDR2 are shown in SEQ ID NOs: 510 and 509, respectively;

the amino acid sequence and the nucleotide sequence of the L-chain CDR3 are shown in SEQ ID NOs: 512 and 511, respectively.

For the IR-039 antibody of the present invention:

the amino acid sequence and the nucleotide sequence of the H-chain variable region (VH) are shown in SEQ ID NOs: 2418 and 2417, respectively;

the amino acid sequence and the nucleotide sequence of the L-chain variable region (VL) are shown in SEQ ID NOs: 2420 and 2419, respectively;

the amino acid sequence and the nucleotide sequence of the H-chain CDR1 are shown in SEQ ID NOs: 518 and 517, respectively;

the amino acid sequence and the nucleotide sequence of the H-chain CDR2 are shown in SEQ ID NOs: 520 and 519, respectively;

the amino acid sequence and the nucleotide sequence of the H-chain CDR3 are shown in SEQ ID NOs: 522 and 521, respectively;

the amino acid sequence and the nucleotide sequence of the L-chain CDR1 are shown in SEQ ID NOs: 524 and 523, respectively;

the amino acid sequence and the nucleotide sequence of the L-chain CDR2 are shown in SEQ ID NOs: 526 and 525, respectively;

the amino acid sequence and the nucleotide sequence of the L-chain CDR3 are shown in SEQ ID NOs: 528 and 527, respectively.

For the IR-040 antibody of the present invention:
the amino acid sequence and the nucleotide sequence of the H-chain variable region (VH) are shown in SEQ ID NOs: 2422 and 2421, respectively;
the amino acid sequence and the nucleotide sequence of the L-chain variable region (VL) are shown in SEQ ID NOs: 2424 and 2423, respectively;
the amino acid sequence and the nucleotide sequence of the H-chain CDR1 are shown in SEQ ID NOs: 534 and 533, respectively;
the amino acid sequence and the nucleotide sequence of the H-chain CDR2 are shown in SEQ ID NOs: 536 and 535, respectively;
the amino acid sequence and the nucleotide sequence of the H-chain CDR3 are shown in SEQ ID NOs: 538 and 537, respectively;
the amino acid sequence and the nucleotide sequence of the L-chain CDR1 are shown in SEQ ID NOs: 540 and 539, respectively;
the amino acid sequence and the nucleotide sequence of the L-chain CDR2 are shown in SEQ ID NOs: 542 and 541, respectively;
the amino acid sequence and the nucleotide sequence of the L-chain CDR3 are shown in SEQ ID NOs: 544 and 543, respectively.

For the IR-041 antibody of the present invention:
the amino acid sequence and the nucleotide sequence of the H-chain variable region (VH) are shown in SEQ ID NOs: 2426 and 2425, respectively;
the amino acid sequence and the nucleotide sequence of the L-chain variable region (VL) are shown in SEQ ID NOs: 2428 and 2427, respectively;
the amino acid sequence and the nucleotide sequence of the H-chain CDR1 are shown in SEQ ID NOs: 550 and 549, respectively;
the amino acid sequence and the nucleotide sequence of the H-chain CDR2 are shown in SEQ ID NOs: 552 and 551, respectively;
the amino acid sequence and the nucleotide sequence of the H-chain CDR3 are shown in SEQ ID NOs: 554 and 553, respectively;
the amino acid sequence and the nucleotide sequence of the L-chain CDR1 are shown in SEQ ID NOs: 556 and 555, respectively;
the amino acid sequence and the nucleotide sequence of the L-chain CDR2 are shown in SEQ ID NOs: 558 and 557, respectively;
the amino acid sequence and the nucleotide sequence of the L-chain CDR3 are shown in SEQ ID NOs: 560 and 559, respectively.

For the IR-043 antibody of the present invention:
the amino acid sequence and the nucleotide sequence of the H-chain variable region (VH) are shown in SEQ ID NOs: 2430 and 2429, respectively;
the amino acid sequence and the nucleotide sequence of the L-chain variable region (VL) are shown in SEQ ID NOs: 2432 and 2431, respectively;
the amino acid sequence and the nucleotide sequence of the H-chain CDR1 are shown in SEQ ID NOs: 566 and 565, respectively;
the amino acid sequence and the nucleotide sequence of the H-chain CDR2 are shown in SEQ ID NOs: 568 and 567, respectively;
the amino acid sequence and the nucleotide sequence of the H-chain CDR3 are shown in SEQ ID NOs: 570 and 569, respectively;
the amino acid sequence and the nucleotide sequence of the L-chain CDR1 are shown in SEQ ID NOs: 572 and 571, respectively;
the amino acid sequence and the nucleotide sequence of the L-chain CDR2 are shown in SEQ ID NOs: 574 and 573, respectively;
the amino acid sequence and the nucleotide sequence of the L-chain CDR3 are shown in SEQ ID NOs: 576 and 575, respectively.

For the IR-044 antibody of the present invention:
the amino acid sequence and the nucleotide sequence of the H-chain variable region (VH) are shown in SEQ ID NOs: 2434 and 2433, respectively;
the amino acid sequence and the nucleotide sequence of the L-chain variable region (VL) are shown in SEQ ID NOs: 2436 and 2435, respectively;
the amino acid sequence and the nucleotide sequence of the H-chain CDR1 are shown in SEQ ID NOs: 582 and 581, respectively;
the amino acid sequence and the nucleotide sequence of the H-chain CDR2 are shown in SEQ ID NOs: 584 and 583, respectively;
the amino acid sequence and the nucleotide sequence of the H-chain CDR3 are shown in SEQ ID NOs: 586 and 585, respectively;
the amino acid sequence and the nucleotide sequence of the L-chain CDR1 are shown in SEQ ID NOs: 588 and 587, respectively;
the amino acid sequence and the nucleotide sequence of the L-chain CDR2 are shown in SEQ ID NOs: 590 and 589, respectively;
the amino acid sequence and the nucleotide sequence of the L-chain CDR3 are shown in SEQ ID NOs: 592 and 591, respectively.

For the IR-045 antibody of the present invention:
the amino acid sequence and the nucleotide sequence of the H-chain variable region (VH) are shown in SEQ ID NOs: 2438 and 2437, respectively;
the amino acid sequence and the nucleotide sequence of the L-chain variable region (VL) are shown in SEQ ID NOs: 2440 and 2439, respectively;
the amino acid sequence and the nucleotide sequence of the H-chain CDR1 are shown in SEQ ID NOs: 598 and 597, respectively;
the amino acid sequence and the nucleotide sequence of the H-chain CDR2 are shown in SEQ ID NOs: 600 and 599, respectively;
the amino acid sequence and the nucleotide sequence of the H-chain CDR3 are shown in SEQ ID NOs: 602 and 601, respectively;
the amino acid sequence and the nucleotide sequence of the L-chain CDR1 are shown in SEQ ID NOs: 604 and 603, respectively;
the amino acid sequence and the nucleotide sequence of the L-chain CDR2 are shown in SEQ ID NOs: 606 and 605, respectively;
the amino acid sequence and the nucleotide sequence of the L-chain CDR3 are shown in SEQ ID NOs: 608 and 607, respectively.

For the IR-046 antibody of the present invention:
the amino acid sequence and the nucleotide sequence of the H-chain variable region (VH) are shown in SEQ ID NOs: 2442 and 2441, respectively;

the amino acid sequence and the nucleotide sequence of the L-chain variable region (VL) are shown in SEQ ID NOs: 2444 and 2443, respectively;

the amino acid sequence and the nucleotide sequence of the H-chain CDR1 are shown in SEQ ID NOs: 614 and 613, respectively;

the amino acid sequence and the nucleotide sequence of the H-chain CDR2 are shown in SEQ ID NOs: 616 and 615, respectively;

the amino acid sequence and the nucleotide sequence of the H-chain CDR3 are shown in SEQ ID NOs: 618 and 617, respectively;

the amino acid sequence and the nucleotide sequence of the L-chain CDR1 are shown in SEQ ID NOs: 620 and 619, respectively;

the amino acid sequence and the nucleotide sequence of the L-chain CDR2 are shown in SEQ ID NOs: 622 and 621, respectively;

the amino acid sequence and the nucleotide sequence of the L-chain CDR3 are shown in SEQ ID NOs: 624 and 623, respectively.

For the IR-048 antibody of the present invention:

the amino acid sequence and the nucleotide sequence of the H-chain variable region (VH) are shown in SEQ ID NOs: 2446 and 2445, respectively;

the amino acid sequence and the nucleotide sequence of the L-chain variable region (VL) are shown in SEQ ID NOs: 2448 and 2447, respectively;

the amino acid sequence and the nucleotide sequence of the H-chain CDR1 are shown in SEQ ID NOs: 630 and 629, respectively;

the amino acid sequence and the nucleotide sequence of the H-chain CDR2 are shown in SEQ ID NOs: 632 and 631, respectively;

the amino acid sequence and the nucleotide sequence of the H-chain CDR3 are shown in SEQ ID NOs: 634 and 633, respectively;

the amino acid sequence and the nucleotide sequence of the L-chain CDR1 are shown in SEQ ID NOs: 636 and 635, respectively;

the amino acid sequence and the nucleotide sequence of the L-chain CDR2 are shown in SEQ ID NOs: 638 and 637, respectively;

the amino acid sequence and the nucleotide sequence of the L-chain CDR3 are shown in SEQ ID NOs: 640 and 639, respectively.

For the IR-049 antibody of the present invention:

the amino acid sequence and the nucleotide sequence of the H-chain variable region (VH) are shown in SEQ ID NOs: 2450 and 2449, respectively;

the amino acid sequence and the nucleotide sequence of the L-chain variable region (VL) are shown in SEQ ID NOs: 2452 and 2451, respectively;

the amino acid sequence and the nucleotide sequence of the H-chain CDR1 are shown in SEQ ID NOs: 646 and 645, respectively;

the amino acid sequence and the nucleotide sequence of the H-chain CDR2 are shown in SEQ ID NOs: 648 and 647, respectively;

the amino acid sequence and the nucleotide sequence of the H-chain CDR3 are shown in SEQ ID NOs: 650 and 649, respectively;

the amino acid sequence and the nucleotide sequence of the L-chain CDR1 are shown in SEQ ID NOs: 652 and 651, respectively;

the amino acid sequence and the nucleotide sequence of the L-chain CDR2 are shown in SEQ ID NOs: 654 and 653, respectively;

the amino acid sequence and the nucleotide sequence of the L-chain CDR3 are shown in SEQ ID NOs: 656 and 655, respectively.

For the IR-050 antibody of the present invention:

the amino acid sequence and the nucleotide sequence of the H-chain variable region (VH) are shown in SEQ ID NOs: 2454 and 2453, respectively;

the amino acid sequence and the nucleotide sequence of the L-chain variable region (VL) are shown in SEQ ID NOs: 2456 and 2455, respectively;

the amino acid sequence and the nucleotide sequence of the H-chain CDR1 are shown in SEQ ID NOs: 662 and 661, respectively;

the amino acid sequence and the nucleotide sequence of the H-chain CDR2 are shown in SEQ ID NOs: 664 and 663, respectively;

the amino acid sequence and the nucleotide sequence of the H-chain CDR3 are shown in SEQ ID NOs: 666 and 665, respectively;

the amino acid sequence and the nucleotide sequence of the L-chain CDR1 are shown in SEQ ID NOs: 668 and 667, respectively;

the amino acid sequence and the nucleotide sequence of the L-chain CDR2 are shown in SEQ ID NOs: 670 and 669, respectively;

the amino acid sequence and the nucleotide sequence of the L-chain CDR3 are shown in SEQ ID NOs: 672 and 671, respectively.

For the IR-051 antibody of the present invention:

the amino acid sequence and the nucleotide sequence of the H-chain variable region (VH) are shown in SEQ ID NOs: 2458 and 2457, respectively;

the amino acid sequence and the nucleotide sequence of the L-chain variable region (VL) are shown in SEQ ID NOs: 2460 and 2459, respectively;

the amino acid sequence and the nucleotide sequence of the H-chain CDR1 are shown in SEQ ID NOs: 678 and 677, respectively;

the amino acid sequence and the nucleotide sequence of the H-chain CDR2 are shown in SEQ ID NOs: 680 and 679, respectively;

the amino acid sequence and the nucleotide sequence of the H-chain CDR3 are shown in SEQ ID NOs: 682 and 681, respectively;

the amino acid sequence and the nucleotide sequence of the L-chain CDR1 are shown in SEQ ID NOs: 684 and 683, respectively;

the amino acid sequence and the nucleotide sequence of the L-chain CDR2 are shown in SEQ ID NOs: 686 and 685, respectively;

the amino acid sequence and the nucleotide sequence of the L-chain CDR3 are shown in SEQ ID NOs: 688 and 687, respectively.

For the IR-052 antibody of the present invention:

the amino acid sequence and the nucleotide sequence of the H-chain variable region (VH) are shown in SEQ ID NOs: 2462 and 2461, respectively;

the amino acid sequence and the nucleotide sequence of the L-chain variable region (VL) are shown in SEQ ID NOs: 2464 and 2463, respectively;

the amino acid sequence and the nucleotide sequence of the H-chain CDR1 are shown in SEQ ID NOs: 694 and 693, respectively;

the amino acid sequence and the nucleotide sequence of the H-chain CDR2 are shown in SEQ ID NOs: 696 and 695, respectively;

the amino acid sequence and the nucleotide sequence of the H-chain CDR3 are shown in SEQ ID NOs: 698 and 697, respectively;

the amino acid sequence and the nucleotide sequence of the L-chain CDR1 are shown in SEQ ID NOs: 700 and 699, respectively;

the amino acid sequence and the nucleotide sequence of the L-chain CDR2 are shown in SEQ ID NOs: 702 and 701, respectively;

the amino acid sequence and the nucleotide sequence of the L-chain CDR3 are shown in SEQ ID NOs: 704 and 703, respectively.

For the IR-053 antibody of the present invention:

the amino acid sequence and the nucleotide sequence of the H-chain variable region (VH) are shown in SEQ ID NOs: 2466 and 2465, respectively;

the amino acid sequence and the nucleotide sequence of the L-chain variable region (VL) are shown in SEQ ID NOs: 2468 and 2467, respectively;

the amino acid sequence and the nucleotide sequence of the H-chain CDR1 are shown in SEQ ID NOs: 710 and 709, respectively;

the amino acid sequence and the nucleotide sequence of the H-chain CDR2 are shown in SEQ ID NOs: 712 and 711, respectively;

the amino acid sequence and the nucleotide sequence of the H-chain CDR3 are shown in SEQ ID NOs: 714 and 713, respectively;

the amino acid sequence and the nucleotide sequence of the L-chain CDR1 are shown in SEQ ID NOs: 716 and 715, respectively;

the amino acid sequence and the nucleotide sequence of the L-chain CDR2 are shown in SEQ ID NOs: 718 and 717, respectively;

the amino acid sequence and the nucleotide sequence of the L-chain CDR3 are shown in SEQ ID NOs: 720 and 719, respectively.

For the IR-054 antibody of the present invention:

the amino acid sequence and the nucleotide sequence of the H-chain variable region (VH) are shown in SEQ ID NOs: 2470 and 2469, respectively;

the amino acid sequence and the nucleotide sequence of the L-chain variable region (VL) are shown in SEQ ID NOs: 2472 and 2471, respectively;

the amino acid sequence and the nucleotide sequence of the H-chain CDR1 are shown in SEQ ID NOs: 726 and 725, respectively;

the amino acid sequence and the nucleotide sequence of the H-chain CDR2 are shown in SEQ ID NOs: 728 and 727, respectively;

the amino acid sequence and the nucleotide sequence of the H-chain CDR3 are shown in SEQ ID NOs: 730 and 729, respectively;

the amino acid sequence and the nucleotide sequence of the L-chain CDR1 are shown in SEQ ID NOs: 732 and 731, respectively;

the amino acid sequence and the nucleotide sequence of the L-chain CDR2 are shown in SEQ ID NOs: 734 and 733, respectively;

the amino acid sequence and the nucleotide sequence of the L-chain CDR3 are shown in SEQ ID NOs: 736 and 735, respectively.

For the IR-055 antibody of the present invention:

the amino acid sequence and the nucleotide sequence of the H-chain variable region (VH) are shown in SEQ ID NOs: 2474 and 2473, respectively;

the amino acid sequence and the nucleotide sequence of the L-chain variable region (VL) are shown in SEQ ID NOs: 2476 and 2475, respectively;

the amino acid sequence and the nucleotide sequence of the H-chain CDR1 are shown in SEQ ID NOs: 742 and 741, respectively;

the amino acid sequence and the nucleotide sequence of the H-chain CDR2 are shown in SEQ ID NOs: 744 and 743, respectively;

the amino acid sequence and the nucleotide sequence of the H-chain CDR3 are shown in SEQ ID NOs: 746 and 745, respectively;

the amino acid sequence and the nucleotide sequence of the L-chain CDR1 are shown in SEQ ID NOs: 748 and 747, respectively;

the amino acid sequence and the nucleotide sequence of the L-chain CDR2 are shown in SEQ ID NOs: 750 and 749, respectively;

the amino acid sequence and the nucleotide sequence of the L-chain CDR3 are shown in SEQ ID NOs: 752 and 751, respectively.

For the IR-056 antibody of the present invention:

the amino acid sequence and the nucleotide sequence of the H-chain variable region (VH) are shown in SEQ ID NOs: 2478 and 2477, respectively;

the amino acid sequence and the nucleotide sequence of the L-chain variable region (VL) are shown in SEQ ID NOs: 2480 and 2479, respectively;

the amino acid sequence and the nucleotide sequence of the H-chain CDR1 are shown in SEQ ID NOs: 758 and 757, respectively;

the amino acid sequence and the nucleotide sequence of the H-chain CDR2 are shown in SEQ ID NOs: 760 and 759, respectively;

the amino acid sequence and the nucleotide sequence of the H-chain CDR3 are shown in SEQ ID NOs: 762 and 761, respectively;

the amino acid sequence and the nucleotide sequence of the L-chain CDR1 are shown in SEQ ID NOs: 764 and 763, respectively;

the amino acid sequence and the nucleotide sequence of the L-chain CDR2 are shown in SEQ ID NOs: 766 and 765, respectively;

the amino acid sequence and the nucleotide sequence of the L-chain CDR3 are shown in SEQ ID NOs: 768 and 767, respectively.

For the IR-057 antibody of the present invention:

the amino acid sequence and the nucleotide sequence of the H-chain variable region (VH) are shown in SEQ ID NOs: 2482 and 2481, respectively;

the amino acid sequence and the nucleotide sequence of the L-chain variable region (VL) are shown in SEQ ID NOs: 2484 and 2483, respectively;

the amino acid sequence and the nucleotide sequence of the H-chain CDR1 are shown in SEQ ID NOs: 774 and 773, respectively;

the amino acid sequence and the nucleotide sequence of the H-chain CDR2 are shown in SEQ ID NOs: 776 and 775, respectively;

the amino acid sequence and the nucleotide sequence of the H-chain CDR3 are shown in SEQ ID NOs: 778 and 777, respectively;

the amino acid sequence and the nucleotide sequence of the L-chain CDR1 are shown in SEQ ID NOs: 780 and 779, respectively;

the amino acid sequence and the nucleotide sequence of the L-chain CDR2 are shown in SEQ ID NOs: 782 and 781, respectively;

the amino acid sequence and the nucleotide sequence of the L-chain CDR3 are shown in SEQ ID NOs: 784 and 783, respectively.

For the IR-058 antibody of the present invention:

the amino acid sequence and the nucleotide sequence of the H-chain variable region (VH) are shown in SEQ ID NOs: 2486 and 2485, respectively;

the amino acid sequence and the nucleotide sequence of the L-chain variable region (VL) are shown in SEQ ID NOs: 2488 and 2487, respectively;

the amino acid sequence and the nucleotide sequence of the H-chain CDR1 are shown in SEQ ID NOs: 790 and 789, respectively;

the amino acid sequence and the nucleotide sequence of the H-chain CDR2 are shown in SEQ ID NOs: 792 and 791, respectively;

the amino acid sequence and the nucleotide sequence of the H-chain CDR3 are shown in SEQ ID NOs: 794 and 793, respectively;

the amino acid sequence and the nucleotide sequence of the L-chain CDR1 are shown in SEQ ID NOs: 796 and 795, respectively;

the amino acid sequence and the nucleotide sequence of the L-chain CDR2 are shown in SEQ ID NOs: 798 and 797, respectively;

the amino acid sequence and the nucleotide sequence of the L-chain CDR3 are shown in SEQ ID NOs: 800 and 799, respectively.

For the IR-059 antibody of the present invention:

the amino acid sequence and the nucleotide sequence of the H-chain variable region (VH) are shown in SEQ ID NOs: 2490 and 2489, respectively;

the amino acid sequence and the nucleotide sequence of the L-chain variable region (VL) are shown in SEQ ID NOs: 2492 and 2491, respectively;

the amino acid sequence and the nucleotide sequence of the H-chain CDR1 are shown in SEQ ID NOs: 806 and 805, respectively;

the amino acid sequence and the nucleotide sequence of the H-chain CDR2 are shown in SEQ ID NOs: 808 and 807, respectively;

the amino acid sequence and the nucleotide sequence of the H-chain CDR3 are shown in SEQ ID NOs: 810 and 809, respectively;

the amino acid sequence and the nucleotide sequence of the L-chain CDR1 are shown in SEQ ID NOs: 812 and 811, respectively;

the amino acid sequence and the nucleotide sequence of the L-chain CDR2 are shown in SEQ ID NOs: 814 and 813, respectively;

the amino acid sequence and the nucleotide sequence of the L-chain CDR3 are shown in SEQ ID NOs: 816 and 815, respectively.

For the IR-060 antibody of the present invention:

the amino acid sequence and the nucleotide sequence of the H-chain variable region (VH) are shown in SEQ ID NOs: 2494 and 2493, respectively;

the amino acid sequence and the nucleotide sequence of the L-chain variable region (VL) are shown in SEQ ID NOs: 2496 and 2495, respectively;

the amino acid sequence and the nucleotide sequence of the H-chain CDR1 are shown in SEQ ID NOs: 822 and 821, respectively;

the amino acid sequence and the nucleotide sequence of the H-chain CDR2 are shown in SEQ ID NOs: 824 and 823, respectively;

the amino acid sequence and the nucleotide sequence of the H-chain CDR3 are shown in SEQ ID NOs: 826 and 825, respectively;

the amino acid sequence and the nucleotide sequence of the L-chain CDR1 are shown in SEQ ID NOs: 828 and 827, respectively;

the amino acid sequence and the nucleotide sequence of the L-chain CDR2 are shown in SEQ ID NOs: 830 and 829, respectively;

the amino acid sequence and the nucleotide sequence of the L-chain CDR3 are shown in SEQ ID NOs: 832 and 831, respectively.

For the IR-061 antibody of the present invention:

the amino acid sequence and the nucleotide sequence of the H-chain variable region (VH) are shown in SEQ ID NOs: 2498 and 2497, respectively;

the amino acid sequence and the nucleotide sequence of the L-chain variable region (VL) are shown in SEQ ID NOs: 2500 and 2499, respectively;

the amino acid sequence and the nucleotide sequence of the H-chain CDR1 are shown in SEQ ID NOs: 838 and 837, respectively;

the amino acid sequence and the nucleotide sequence of the H-chain CDR2 are shown in SEQ ID NOs: 840 and 839, respectively;

the amino acid sequence and the nucleotide sequence of the H-chain CDR3 are shown in SEQ ID NOs: 842 and 841, respectively;

the amino acid sequence and the nucleotide sequence of the L-chain CDR1 are shown in SEQ ID NOs: 844 and 843, respectively;

the amino acid sequence and the nucleotide sequence of the L-chain CDR2 are shown in SEQ ID NOs: 846 and 845, respectively;

the amino acid sequence and the nucleotide sequence of the L-chain CDR3 are shown in SEQ ID NOs: 848 and 847, respectively.

For the IR-062 antibody of the present invention:

the amino acid sequence and the nucleotide sequence of the H-chain variable region (VH) are shown in SEQ ID NOs: 2502 and 2501, respectively;

the amino acid sequence and the nucleotide sequence of the L-chain variable region (VL) are shown in SEQ ID NOs: 2504 and 2503, respectively;

the amino acid sequence and the nucleotide sequence of the H-chain CDR1 are shown in SEQ ID NOs: 854 and 853, respectively;

the amino acid sequence and the nucleotide sequence of the H-chain CDR2 are shown in SEQ ID NOs: 856 and 855, respectively;

the amino acid sequence and the nucleotide sequence of the H-chain CDR3 are shown in SEQ ID NOs: 858 and 857, respectively;

the amino acid sequence and the nucleotide sequence of the L-chain CDR1 are shown in SEQ ID NOs: 860 and 859, respectively;

the amino acid sequence and the nucleotide sequence of the L-chain CDR2 are shown in SEQ ID NOs: 862 and 861, respectively;

the amino acid sequence and the nucleotide sequence of the L-chain CDR3 are shown in SEQ ID NOs: 864 and 863, respectively.

For the IR-063 antibody of the present invention:
the amino acid sequence and the nucleotide sequence of the H-chain variable region (VH) are shown in SEQ ID NOs: 2506 and 2505, respectively;
the amino acid sequence and the nucleotide sequence of the L-chain variable region (VL) are shown in SEQ ID NOs: 2508 and 2507, respectively;
the amino acid sequence and the nucleotide sequence of the H-chain CDR1 are shown in SEQ ID NOs: 870 and 869, respectively;
the amino acid sequence and the nucleotide sequence of the H-chain CDR2 are shown in SEQ ID NOs: 872 and 871, respectively;
the amino acid sequence and the nucleotide sequence of the H-chain CDR3 are shown in SEQ ID NOs: 874 and 873, respectively;
the amino acid sequence and the nucleotide sequence of the L-chain CDR1 are shown in SEQ ID NOs: 876 and 875, respectively;
the amino acid sequence and the nucleotide sequence of the L-chain CDR2 are shown in SEQ ID NOs: 878 and 877, respectively;
the amino acid sequence and the nucleotide sequence of the L-chain CDR3 are shown in SEQ ID NOs: 880 and 879, respectively.

For the IR-064 antibody of the present invention:
the amino acid sequence and the nucleotide sequence of the H-chain variable region (VH) are shown in SEQ ID NOs: 2510 and 2509, respectively;
the amino acid sequence and the nucleotide sequence of the L-chain variable region (VL) are shown in SEQ ID NOs: 2512 and 2511, respectively;
the amino acid sequence and the nucleotide sequence of the H-chain CDR1 are shown in SEQ ID NOs: 886 and 885, respectively;
the amino acid sequence and the nucleotide sequence of the H-chain CDR2 are shown in SEQ ID NOs: 888 and 887, respectively;
the amino acid sequence and the nucleotide sequence of the H-chain CDR3 are shown in SEQ ID NOs: 890 and 889, respectively;
the amino acid sequence and the nucleotide sequence of the L-chain CDR1 are shown in SEQ ID NOs: 892 and 891, respectively;
the amino acid sequence and the nucleotide sequence of the L-chain CDR2 are shown in SEQ ID NOs: 894 and 893, respectively;
the amino acid sequence and the nucleotide sequence of the L-chain CDR3 are shown in SEQ ID NOs: 896 and 895, respectively.

For the IR-065 antibody of the present invention:
the amino acid sequence and the nucleotide sequence of the H-chain variable region (VH) are shown in SEQ ID NOs: 2514 and 2513, respectively;
the amino acid sequence and the nucleotide sequence of the L-chain variable region (VL) are shown in SEQ ID NOs: 2516 and 2515, respectively;
the amino acid sequence and the nucleotide sequence of the H-chain CDR1 are shown in SEQ ID NOs: 902 and 901, respectively;
the amino acid sequence and the nucleotide sequence of the H-chain CDR2 are shown in SEQ ID NOs: 904 and 903, respectively;
the amino acid sequence and the nucleotide sequence of the H-chain CDR3 are shown in SEQ ID NOs: 906 and 905, respectively;
the amino acid sequence and the nucleotide sequence of the L-chain CDR1 are shown in SEQ ID NOs: 908 and 907, respectively;
the amino acid sequence and the nucleotide sequence of the L-chain CDR2 are shown in SEQ ID NOs: 910 and 909, respectively;
the amino acid sequence and the nucleotide sequence of the L-chain CDR3 are shown in SEQ ID NOs: 912 and 911, respectively.

For the IR-066 antibody of the present invention:
the amino acid sequence and the nucleotide sequence of the H-chain variable region (VH) are shown in SEQ ID NOs: 2518 and 2517, respectively;
the amino acid sequence and the nucleotide sequence of the L-chain variable region (VL) are shown in SEQ ID NOs: 2520 and 2519, respectively;
the amino acid sequence and the nucleotide sequence of the H-chain CDR1 are shown in SEQ ID NOs: 918 and 917, respectively;
the amino acid sequence and the nucleotide sequence of the H-chain CDR2 are shown in SEQ ID NOs: 920 and 919, respectively;
the amino acid sequence and the nucleotide sequence of the H-chain CDR3 are shown in SEQ ID NOs: 922 and 921, respectively;
the amino acid sequence and the nucleotide sequence of the L-chain CDR1 are shown in SEQ ID NOs: 924 and 923, respectively;
the amino acid sequence and the nucleotide sequence of the L-chain CDR2 are shown in SEQ ID NOs: 926 and 925, respectively;
the amino acid sequence and the nucleotide sequence of the L-chain CDR3 are shown in SEQ ID NOs: 928 and 927, respectively.

For the IR-067 antibody of the present invention:
the amino acid sequence and the nucleotide sequence of the H-chain variable region (VH) are shown in SEQ ID NOs: 2522 and 2521, respectively;
the amino acid sequence and the nucleotide sequence of the L-chain variable region (VL) are shown in SEQ ID NOs: 2524 and 2523, respectively;
the amino acid sequence and the nucleotide sequence of the H-chain CDR1 are shown in SEQ ID NOs: 934 and 933, respectively;
the amino acid sequence and the nucleotide sequence of the H-chain CDR2 are shown in SEQ ID NOs: 936 and 935, respectively;
the amino acid sequence and the nucleotide sequence of the H-chain CDR3 are shown in SEQ ID NOs: 938 and 937, respectively;
the amino acid sequence and the nucleotide sequence of the L-chain CDR1 are shown in SEQ ID NOs: 940 and 939, respectively;
the amino acid sequence and the nucleotide sequence of the L-chain CDR2 are shown in SEQ ID NOs: 942 and 941, respectively;
the amino acid sequence and the nucleotide sequence of the L-chain CDR3 are shown in SEQ ID NOs: 944 and 943, respectively.

For the IR-068 antibody of the present invention:
the amino acid sequence and the nucleotide sequence of the H-chain variable region (VH) are shown in SEQ ID NOs: 2526 and 2525, respectively;

the amino acid sequence and the nucleotide sequence of the L-chain variable region (VL) are shown in SEQ ID NOs: 2528 and 2527, respectively;

the amino acid sequence and the nucleotide sequence of the H-chain CDR1 are shown in SEQ ID NOs: 950 and 949, respectively;

the amino acid sequence and the nucleotide sequence of the H-chain CDR2 are shown in SEQ ID NOs: 952 and 951, respectively;

the amino acid sequence and the nucleotide sequence of the H-chain CDR3 are shown in SEQ ID NOs: 954 and 953, respectively;

the amino acid sequence and the nucleotide sequence of the L-chain CDR1 are shown in SEQ ID NOs: 956 and 955, respectively;

the amino acid sequence and the nucleotide sequence of the L-chain CDR2 are shown in SEQ ID NOs: 958 and 957, respectively;

the amino acid sequence and the nucleotide sequence of the L-chain CDR3 are shown in SEQ ID NOs: 960 and 959, respectively.

For the IR-069 antibody of the present invention:

the amino acid sequence and the nucleotide sequence of the H-chain variable region (VH) are shown in SEQ ID NOs: 2530 and 2529, respectively;

the amino acid sequence and the nucleotide sequence of the L-chain variable region (VL) are shown in SEQ ID NOs: 2532 and 2531, respectively;

the amino acid sequence and the nucleotide sequence of the H-chain CDR1 are shown in SEQ ID NOs: 966 and 965, respectively;

the amino acid sequence and the nucleotide sequence of the H-chain CDR2 are shown in SEQ ID NOs: 968 and 967, respectively;

the amino acid sequence and the nucleotide sequence of the H-chain CDR3 are shown in SEQ ID NOs: 970 and 969, respectively;

the amino acid sequence and the nucleotide sequence of the L-chain CDR1 are shown in SEQ ID NOs: 972 and 971, respectively;

the amino acid sequence and the nucleotide sequence of the L-chain CDR2 are shown in SEQ ID NOs: 974 and 973, respectively;

the amino acid sequence and the nucleotide sequence of the L-chain CDR3 are shown in SEQ ID NOs: 976 and 975, respectively.

For the IR-070 antibody of the present invention:

the amino acid sequence and the nucleotide sequence of the H-chain variable region (VH) are shown in SEQ ID NOs: 2534 and 2533, respectively;

the amino acid sequence and the nucleotide sequence of the L-chain variable region (VL) are shown in SEQ ID NOs: 2536 and 2535, respectively;

the amino acid sequence and the nucleotide sequence of the H-chain CDR1 are shown in SEQ ID NOs: 982 and 981, respectively;

the amino acid sequence and the nucleotide sequence of the H-chain CDR2 are shown in SEQ ID NOs: 984 and 983, respectively;

the amino acid sequence and the nucleotide sequence of the H-chain CDR3 are shown in SEQ ID NOs: 986 and 985, respectively;

the amino acid sequence and the nucleotide sequence of the L-chain CDR1 are shown in SEQ ID NOs: 988 and 987, respectively;

the amino acid sequence and the nucleotide sequence of the L-chain CDR2 are shown in SEQ ID NOs: 990 and 989, respectively;

the amino acid sequence and the nucleotide sequence of the L-chain CDR3 are shown in SEQ ID NOs: 992 and 991, respectively.

For the IR-071 antibody of the present invention:

the amino acid sequence and the nucleotide sequence of the H-chain variable region (VH) are shown in SEQ ID NOs: 2538 and 2537, respectively;

the amino acid sequence and the nucleotide sequence of the L-chain variable region (VL) are shown in SEQ ID NOs: 2540 and 2539, respectively;

the amino acid sequence and the nucleotide sequence of the H-chain CDR1 are shown in SEQ ID NOs: 998 and 997, respectively;

the amino acid sequence and the nucleotide sequence of the H-chain CDR2 are shown in SEQ ID NOs: 1000 and 999, respectively;

the amino acid sequence and the nucleotide sequence of the H-chain CDR3 are shown in SEQ ID NOs: 1002 and 1001, respectively;

the amino acid sequence and the nucleotide sequence of the L-chain CDR1 are shown in SEQ ID NOs: 1004 and 1003, respectively;

the amino acid sequence and the nucleotide sequence of the L-chain CDR2 are shown in SEQ ID NOs: 1006 and 1005, respectively;

the amino acid sequence and the nucleotide sequence of the L-chain CDR3 are shown in SEQ ID NOs: 1008 and 1007, respectively.

For the IR-072 antibody of the present invention:

the amino acid sequence and the nucleotide sequence of the H-chain variable region (VH) are shown in SEQ ID NOs: 2542 and 2541, respectively;

the amino acid sequence and the nucleotide sequence of the L-chain variable region (VL) are shown in SEQ ID NOs: 2544 and 2543, respectively;

the amino acid sequence and the nucleotide sequence of the H-chain CDR1 are shown in SEQ ID NOs: 1014 and 1013, respectively;

the amino acid sequence and the nucleotide sequence of the H-chain CDR2 are shown in SEQ ID NOs: 1016 and 1015, respectively;

the amino acid sequence and the nucleotide sequence of the H-chain CDR3 are shown in SEQ ID NOs: 1018 and 1017, respectively;

the amino acid sequence and the nucleotide sequence of the L-chain CDR1 are shown in SEQ ID NOs: 1020 and 1019, respectively;

the amino acid sequence and the nucleotide sequence of the L-chain CDR2 are shown in SEQ ID NOs: 1022 and 1021, respectively;

the amino acid sequence and the nucleotide sequence of the L-chain CDR3 are shown in SEQ ID NOs: 1024 and 1023, respectively.

For the IR-073 antibody of the present invention:

the amino acid sequence and the nucleotide sequence of the H-chain variable region (VH) are shown in SEQ ID NOs: 2546 and 2545, respectively;

the amino acid sequence and the nucleotide sequence of the L-chain variable region (VL) are shown in SEQ ID NOs: 2548 and 2547, respectively;

the amino acid sequence and the nucleotide sequence of the H-chain CDR1 are shown in SEQ ID NOs: 1030 and 1029, respectively;

the amino acid sequence and the nucleotide sequence of the H-chain CDR2 are shown in SEQ ID NOs: 1032 and 1031, respectively;

the amino acid sequence and the nucleotide sequence of the H-chain CDR3 are shown in SEQ ID NOs: 1034 and 1033, respectively;

the amino acid sequence and the nucleotide sequence of the L-chain CDR1 are shown in SEQ ID NOs: 1036 and 1035, respectively;

the amino acid sequence and the nucleotide sequence of the L-chain CDR2 are shown in SEQ ID NOs: 1038 and 1037, respectively;

the amino acid sequence and the nucleotide sequence of the L-chain CDR3 are shown in SEQ ID NOs: 1040 and 1039, respectively.

For the IR-074 antibody of the present invention:

the amino acid sequence and the nucleotide sequence of the H-chain variable region (VH) are shown in SEQ ID NOs: 2550 and 2549, respectively;

the amino acid sequence and the nucleotide sequence of the L-chain variable region (VL) are shown in SEQ ID NOs: 2552 and 2551, respectively;

the amino acid sequence and the nucleotide sequence of the H-chain CDR1 are shown in SEQ ID NOs: 1046 and 1045, respectively;

the amino acid sequence and the nucleotide sequence of the H-chain CDR2 are shown in SEQ ID NOs: 1048 and 1047, respectively;

the amino acid sequence and the nucleotide sequence of the H-chain CDR3 are shown in SEQ ID NOs: 1050 and 1049, respectively;

the amino acid sequence and the nucleotide sequence of the L-chain CDR1 are shown in SEQ ID NOs: 1052 and 1051, respectively;

the amino acid sequence and the nucleotide sequence of the L-chain CDR2 are shown in SEQ ID NOs: 1054 and 1053, respectively;

the amino acid sequence and the nucleotide sequence of the L-chain CDR3 are shown in SEQ ID NOs: 1056 and 1055, respectively.

For the IR-075 antibody of the present invention:

the amino acid sequence and the nucleotide sequence of the H-chain variable region (VH) are shown in SEQ ID NOs: 2554 and 2553, respectively;

the amino acid sequence and the nucleotide sequence of the L-chain variable region (VL) are shown in SEQ ID NOs: 2556 and 2555, respectively;

the amino acid sequence and the nucleotide sequence of the H-chain CDR1 are shown in SEQ ID NOs: 1062 and 1061, respectively;

the amino acid sequence and the nucleotide sequence of the H-chain CDR2 are shown in SEQ ID NOs: 1064 and 1063, respectively;

the amino acid sequence and the nucleotide sequence of the H-chain CDR3 are shown in SEQ ID NOs: 1066 and 1065, respectively;

the amino acid sequence and the nucleotide sequence of the L-chain CDR1 are shown in SEQ ID NOs: 1068 and 1067, respectively;

the amino acid sequence and the nucleotide sequence of the L-chain CDR2 are shown in SEQ ID NOs: 1070 and 1069, respectively;

the amino acid sequence and the nucleotide sequence of the L-chain CDR3 are shown in SEQ ID NOs: 1072 and 1071, respectively.

For the IR-076 antibody of the present invention:

the amino acid sequence and the nucleotide sequence of the H-chain variable region (VH) are shown in SEQ ID NOs: 2558 and 2557, respectively;

the amino acid sequence and the nucleotide sequence of the L-chain variable region (VL) are shown in SEQ ID NOs: 2560 and 2559, respectively;

the amino acid sequence and the nucleotide sequence of the H-chain CDR1 are shown in SEQ ID NOs: 1078 and 1077, respectively;

the amino acid sequence and the nucleotide sequence of the H-chain CDR2 are shown in SEQ ID NOs: 1080 and 1079, respectively;

the amino acid sequence and the nucleotide sequence of the H-chain CDR3 are shown in SEQ ID NOs: 1082 and 1081, respectively;

the amino acid sequence and the nucleotide sequence of the L-chain CDR1 are shown in SEQ ID NOs: 1084 and 1083, respectively;

the amino acid sequence and the nucleotide sequence of the L-chain CDR2 are shown in SEQ ID NOs: 1086 and 1085, respectively;

the amino acid sequence and the nucleotide sequence of the L-chain CDR3 are shown in SEQ ID NOs: 1088 and 1087, respectively.

For the IR-077 antibody of the present invention:

the amino acid sequence and the nucleotide sequence of the H-chain variable region (VH) are shown in SEQ ID NOs: 2562 and 2561, respectively;

the amino acid sequence and the nucleotide sequence of the L-chain variable region (VL) are shown in SEQ ID NOs: 2564 and 2563, respectively;

the amino acid sequence and the nucleotide sequence of the H-chain CDR1 are shown in SEQ ID NOs: 1094 and 1093, respectively;

the amino acid sequence and the nucleotide sequence of the H-chain CDR2 are shown in SEQ ID NOs: 1096 and 1095, respectively;

the amino acid sequence and the nucleotide sequence of the H-chain CDR3 are shown in SEQ ID NOs: 1098 and 1097, respectively;

the amino acid sequence and the nucleotide sequence of the L-chain CDR1 are shown in SEQ ID NOs: 1100 and 1099, respectively;

the amino acid sequence and the nucleotide sequence of the L-chain CDR2 are shown in SEQ ID NOs: 1102 and 1101, respectively;

the amino acid sequence and the nucleotide sequence of the L-chain CDR3 are shown in SEQ ID NOs: 1104 and 1103, respectively.

For the IR-078 antibody of the present invention:

the amino acid sequence and the nucleotide sequence of the H-chain variable region (VH) are shown in SEQ ID NOs: 2566 and 2565, respectively;

the amino acid sequence and the nucleotide sequence of the L-chain variable region (VL) are shown in SEQ ID NOs: 2568 and 2567, respectively;

the amino acid sequence and the nucleotide sequence of the H-chain CDR1 are shown in SEQ ID NOs: 1110 and 1109, respectively;

the amino acid sequence and the nucleotide sequence of the H-chain CDR2 are shown in SEQ ID NOs: 1112 and 1111, respectively;

the amino acid sequence and the nucleotide sequence of the H-chain CDR3 are shown in SEQ ID NOs: 1114 and 1113, respectively;

the amino acid sequence and the nucleotide sequence of the L-chain CDR1 are shown in SEQ ID NOs: 1116 and 1115, respectively;

the amino acid sequence and the nucleotide sequence of the L-chain CDR2 are shown in SEQ ID NOs: 1118 and 1117, respectively;

the amino acid sequence and the nucleotide sequence of the L-chain CDR3 are shown in SEQ ID NOs: 1120 and 1119, respectively.

For the IR-079 antibody of the present invention:

the amino acid sequence and the nucleotide sequence of the H-chain variable region (VH) are shown in SEQ ID NOs: 2570 and 2569, respectively;

the amino acid sequence and the nucleotide sequence of the L-chain variable region (VL) are shown in SEQ ID NOs: 2572 and 2571, respectively;

the amino acid sequence and the nucleotide sequence of the H-chain CDR1 are shown in SEQ ID NOs: 1126 and 1125, respectively;

the amino acid sequence and the nucleotide sequence of the H-chain CDR2 are shown in SEQ ID NOs: 1128 and 1127, respectively;

the amino acid sequence and the nucleotide sequence of the H-chain CDR3 are shown in SEQ ID NOs: 1130 and 1129, respectively;

the amino acid sequence and the nucleotide sequence of the L-chain CDR1 are shown in SEQ ID NOs: 1132 and 1131, respectively;

the amino acid sequence and the nucleotide sequence of the L-chain CDR2 are shown in SEQ ID NOs: 1134 and 1133, respectively;

the amino acid sequence and the nucleotide sequence of the L-chain CDR3 are shown in SEQ ID NOs: 1136 and 1135, respectively.

For the IR-080 antibody of the present invention:

the amino acid sequence and the nucleotide sequence of the H-chain variable region (VH) are shown in SEQ ID NOs: 2574 and 2573, respectively;

the amino acid sequence and the nucleotide sequence of the L-chain variable region (VL) are shown in SEQ ID NOs: 2576 and 2575, respectively;

the amino acid sequence and the nucleotide sequence of the H-chain CDR1 are shown in SEQ ID NOs: 1142 and 1141, respectively;

the amino acid sequence and the nucleotide sequence of the H-chain CDR2 are shown in SEQ ID NOs: 1144 and 1143, respectively;

the amino acid sequence and the nucleotide sequence of the H-chain CDR3 are shown in SEQ ID NOs: 1146 and 1145, respectively;

the amino acid sequence and the nucleotide sequence of the L-chain CDR1 are shown in SEQ ID NOs: 1148 and 1147, respectively;

the amino acid sequence and the nucleotide sequence of the L-chain CDR2 are shown in SEQ ID NOs: 1150 and 1149, respectively;

the amino acid sequence and the nucleotide sequence of the L-chain CDR3 are shown in SEQ ID NOs: 1152 and 1151, respectively.

For the IR-081 antibody of the present invention:

the amino acid sequence and the nucleotide sequence of the H-chain variable region (VH) are shown in SEQ ID NOs: 2578 and 2577, respectively;

the amino acid sequence and the nucleotide sequence of the L-chain variable region (VL) are shown in SEQ ID NOs: 2580 and 2579, respectively;

the amino acid sequence and the nucleotide sequence of the H-chain CDR1 are shown in SEQ ID NOs: 1158 and 1157, respectively;

the amino acid sequence and the nucleotide sequence of the H-chain CDR2 are shown in SEQ ID NOs: 1160 and 1159, respectively;

the amino acid sequence and the nucleotide sequence of the H-chain CDR3 are shown in SEQ ID NOs: 1162 and 1161, respectively;

the amino acid sequence and the nucleotide sequence of the L-chain CDR1 are shown in SEQ ID NOs: 1164 and 1163, respectively;

the amino acid sequence and the nucleotide sequence of the L-chain CDR2 are shown in SEQ ID NOs: 1166 and 1165, respectively;

the amino acid sequence and the nucleotide sequence of the L-chain CDR3 are shown in SEQ ID NOs: 1168 and 1167, respectively.

For the IR-082 antibody of the present invention:

the amino acid sequence and the nucleotide sequence of the H-chain variable region (VH) are shown in SEQ ID NOs: 2582 and 2581, respectively;

the amino acid sequence and the nucleotide sequence of the L-chain variable region (VL) are shown in SEQ ID NOs: 2584 and 2583, respectively;

the amino acid sequence and the nucleotide sequence of the H-chain CDR1 are shown in SEQ ID NOs: 1174 and 1173, respectively;

the amino acid sequence and the nucleotide sequence of the H-chain CDR2 are shown in SEQ ID NOs: 1176 and 1175, respectively;

the amino acid sequence and the nucleotide sequence of the H-chain CDR3 are shown in SEQ ID NOs: 1178 and 1177, respectively;

the amino acid sequence and the nucleotide sequence of the L-chain CDR1 are shown in SEQ ID NOs: 1180 and 1179, respectively;

the amino acid sequence and the nucleotide sequence of the L-chain CDR2 are shown in SEQ ID NOs: 1182 and 1181, respectively;

the amino acid sequence and the nucleotide sequence of the L-chain CDR3 are shown in SEQ ID NOs: 1184 and 1183, respectively.

For the IR-083 antibody of the present invention:

the amino acid sequence and the nucleotide sequence of the H-chain variable region (VH) are shown in SEQ ID NOs: 2586 and 2585, respectively;

the amino acid sequence and the nucleotide sequence of the L-chain variable region (VL) are shown in SEQ ID NOs: 2588 and 2587, respectively;

the amino acid sequence and the nucleotide sequence of the H-chain CDR1 are shown in SEQ ID NOs: 1190 and 1189, respectively;

the amino acid sequence and the nucleotide sequence of the H-chain CDR2 are shown in SEQ ID NOs: 1192 and 1191, respectively;

the amino acid sequence and the nucleotide sequence of the H-chain CDR3 are shown in SEQ ID NOs: 1194 and 1193, respectively;

the amino acid sequence and the nucleotide sequence of the L-chain CDR1 are shown in SEQ ID NOs: 1196 and 1195, respectively;

the amino acid sequence and the nucleotide sequence of the L-chain CDR2 are shown in SEQ ID NOs: 1198 and 1197, respectively;

the amino acid sequence and the nucleotide sequence of the L-chain CDR3 are shown in SEQ ID NOs: 1200 and 1199, respectively.

For the IR-084 antibody of the present invention:
the amino acid sequence and the nucleotide sequence of the H-chain variable region (VH) are shown in SEQ ID NOs: 2590 and 2589, respectively;
the amino acid sequence and the nucleotide sequence of the L-chain variable region (VL) are shown in SEQ ID NOs: 2592 and 2591, respectively;
the amino acid sequence and the nucleotide sequence of the H-chain CDR1 are shown in SEQ ID NOs: 1206 and 1205, respectively;
the amino acid sequence and the nucleotide sequence of the H-chain CDR2 are shown in SEQ ID NOs: 1208 and 1207, respectively;
the amino acid sequence and the nucleotide sequence of the H-chain CDR3 are shown in SEQ ID NOs: 1210 and 1209, respectively;
the amino acid sequence and the nucleotide sequence of the L-chain CDR1 are shown in SEQ ID NOs: 1212 and 1211, respectively;
the amino acid sequence and the nucleotide sequence of the L-chain CDR2 are shown in SEQ ID NOs: 1214 and 1213, respectively;
the amino acid sequence and the nucleotide sequence of the L-chain CDR3 are shown in SEQ ID NOs: 1216 and 1215, respectively.

For the IR-085 antibody of the present invention:
the amino acid sequence and the nucleotide sequence of the H-chain variable region (VH) are shown in SEQ ID NOs: 2594 and 2593, respectively;
the amino acid sequence and the nucleotide sequence of the L-chain variable region (VL) are shown in SEQ ID NOs: 2596 and 2595, respectively;
the amino acid sequence and the nucleotide sequence of the H-chain CDR1 are shown in SEQ ID NOs: 1222 and 1221, respectively;
the amino acid sequence and the nucleotide sequence of the H-chain CDR2 are shown in SEQ ID NOs: 1224 and 1223, respectively;
the amino acid sequence and the nucleotide sequence of the H-chain CDR3 are shown in SEQ ID NOs: 1226 and 1225, respectively;
the amino acid sequence and the nucleotide sequence of the L-chain CDR1 are shown in SEQ ID NOs: 1228 and 1227, respectively;
the amino acid sequence and the nucleotide sequence of the L-chain CDR2 are shown in SEQ ID NOs: 1230 and 1229, respectively;
the amino acid sequence and the nucleotide sequence of the L-chain CDR3 are shown in SEQ ID NOs: 1232 and 1231, respectively.

For the IR-086 antibody of the present invention:
the amino acid sequence and the nucleotide sequence of the H-chain variable region (VH) are shown in SEQ ID NOs: 2598 and 2597, respectively;
the amino acid sequence and the nucleotide sequence of the L-chain variable region (VL) are shown in SEQ ID NOs: 2600 and 2599, respectively;
the amino acid sequence and the nucleotide sequence of the H-chain CDR1 are shown in SEQ ID NOs: 1238 and 1237, respectively;
the amino acid sequence and the nucleotide sequence of the H-chain CDR2 are shown in SEQ ID NOs: 1240 and 1239, respectively;
the amino acid sequence and the nucleotide sequence of the H-chain CDR3 are shown in SEQ ID NOs: 1242 and 1241, respectively;
the amino acid sequence and the nucleotide sequence of the L-chain CDR1 are shown in SEQ ID NOs: 1244 and 1243, respectively;
the amino acid sequence and the nucleotide sequence of the L-chain CDR2 are shown in SEQ ID NOs: 1246 and 1245, respectively;
the amino acid sequence and the nucleotide sequence of the L-chain CDR3 are shown in SEQ ID NOs: 1248 and 1247, respectively.

For the IR-087 antibody of the present invention:
the amino acid sequence and the nucleotide sequence of the H-chain variable region (VH) are shown in SEQ ID NOs: 2602 and 2601, respectively;
the amino acid sequence and the nucleotide sequence of the L-chain variable region (VL) are shown in SEQ ID NOs: 2604 and 2603, respectively;
the amino acid sequence and the nucleotide sequence of the H-chain CDR1 are shown in SEQ ID NOs: 1254 and 1253, respectively;
the amino acid sequence and the nucleotide sequence of the H-chain CDR2 are shown in SEQ ID NOs: 1256 and 1255, respectively;
the amino acid sequence and the nucleotide sequence of the H-chain CDR3 are shown in SEQ ID NOs: 1258 and 1257, respectively;
the amino acid sequence and the nucleotide sequence of the L-chain CDR1 are shown in SEQ ID NOs: 1260 and 1259, respectively;
the amino acid sequence and the nucleotide sequence of the L-chain CDR2 are shown in SEQ ID NOs: 1262 and 1261, respectively;
the amino acid sequence and the nucleotide sequence of the L-chain CDR3 are shown in SEQ ID NOs: 1264 and 1263, respectively.

For the IR-088 antibody of the present invention:
the amino acid sequence and the nucleotide sequence of the H-chain variable region (VH) are shown in SEQ ID NOs: 2606 and 2605, respectively;
the amino acid sequence and the nucleotide sequence of the L-chain variable region (VL) are shown in SEQ ID NOs: 2608 and 2607, respectively;
the amino acid sequence and the nucleotide sequence of the H-chain CDR1 are shown in SEQ ID NOs: 1270 and 1269, respectively;
the amino acid sequence and the nucleotide sequence of the H-chain CDR2 are shown in SEQ ID NOs: 1272 and 1271, respectively;
the amino acid sequence and the nucleotide sequence of the H-chain CDR3 are shown in SEQ ID NOs: 1274 and 1273, respectively;
the amino acid sequence and the nucleotide sequence of the L-chain CDR1 are shown in SEQ ID NOs: 1276 and 1275, respectively;
the amino acid sequence and the nucleotide sequence of the L-chain CDR2 are shown in SEQ ID NOs: 1278 and 1277, respectively;
the amino acid sequence and the nucleotide sequence of the L-chain CDR3 are shown in SEQ ID NOs: 1280 and 1279, respectively.

For the IR-089 antibody of the present invention:
the amino acid sequence and the nucleotide sequence of the H-chain variable region (VH) are shown in SEQ ID NOs: 2610 and 2609, respectively;

the amino acid sequence and the nucleotide sequence of the L-chain variable region (VL) are shown in SEQ ID NOs: 2612 and 2611, respectively;

the amino acid sequence and the nucleotide sequence of the H-chain CDR1 are shown in SEQ ID NOs: 1286 and 1285, respectively;

the amino acid sequence and the nucleotide sequence of the H-chain CDR2 are shown in SEQ ID NOs: 1288 and 1287, respectively;

the amino acid sequence and the nucleotide sequence of the H-chain CDR3 are shown in SEQ ID NOs: 1290 and 1289, respectively;

the amino acid sequence and the nucleotide sequence of the L-chain CDR1 are shown in SEQ ID NOs: 1292 and 1291, respectively;

the amino acid sequence and the nucleotide sequence of the L-chain CDR2 are shown in SEQ ID NOs: 1294 and 1293, respectively;

the amino acid sequence and the nucleotide sequence of the L-chain CDR3 are shown in SEQ ID NOs: 1296 and 1295, respectively.

For the IR-090 antibody of the present invention:

the amino acid sequence and the nucleotide sequence of the H-chain variable region (VH) are shown in SEQ ID NOs: 2614 and 2613, respectively;

the amino acid sequence and the nucleotide sequence of the L-chain variable region (VL) are shown in SEQ ID NOs: 2616 and 2615, respectively;

the amino acid sequence and the nucleotide sequence of the H-chain CDR1 are shown in SEQ ID NOs: 1302 and 1301, respectively;

the amino acid sequence and the nucleotide sequence of the H-chain CDR2 are shown in SEQ ID NOs: 1304 and 1303, respectively;

the amino acid sequence and the nucleotide sequence of the H-chain CDR3 are shown in SEQ ID NOs: 1306 and 1305, respectively;

the amino acid sequence and the nucleotide sequence of the L-chain CDR1 are shown in SEQ ID NOs: 1308 and 1307, respectively;

the amino acid sequence and the nucleotide sequence of the L-chain CDR2 are shown in SEQ ID NOs: 1310 and 1309, respectively;

the amino acid sequence and the nucleotide sequence of the L-chain CDR3 are shown in SEQ ID NOs: 1312 and 1311, respectively.

For the IR-092 antibody of the present invention:

the amino acid sequence and the nucleotide sequence of the H-chain variable region (VH) are shown in SEQ ID NOs: 2618 and 2617, respectively;

the amino acid sequence and the nucleotide sequence of the L-chain variable region (VL) are shown in SEQ ID NOs: 2620 and 2619, respectively;

the amino acid sequence and the nucleotide sequence of the H-chain CDR1 are shown in SEQ ID NOs: 1318 and 1317, respectively;

the amino acid sequence and the nucleotide sequence of the H-chain CDR2 are shown in SEQ ID NOs: 1320 and 1319, respectively;

the amino acid sequence and the nucleotide sequence of the H-chain CDR3 are shown in SEQ ID NOs: 1322 and 1321, respectively;

the amino acid sequence and the nucleotide sequence of the L-chain CDR1 are shown in SEQ ID NOs: 1324 and 1323, respectively;

the amino acid sequence and the nucleotide sequence of the L-chain CDR2 are shown in SEQ ID NOs: 1326 and 1325, respectively;

the amino acid sequence and the nucleotide sequence of the L-chain CDR3 are shown in SEQ ID NOs: 1328 and 1327, respectively.

For the IR-093 antibody of the present invention:

the amino acid sequence and the nucleotide sequence of the H-chain variable region (VH) are shown in SEQ ID NOs: 2622 and 2621, respectively;

the amino acid sequence and the nucleotide sequence of the L-chain variable region (VL) are shown in SEQ ID NOs: 2624 and 2623, respectively;

the amino acid sequence and the nucleotide sequence of the H-chain CDR1 are shown in SEQ ID NOs: 1334 and 1333, respectively;

the amino acid sequence and the nucleotide sequence of the H-chain CDR2 are shown in SEQ ID NOs: 1336 and 1335, respectively;

the amino acid sequence and the nucleotide sequence of the H-chain CDR3 are shown in SEQ ID NOs: 1338 and 1337, respectively;

the amino acid sequence and the nucleotide sequence of the L-chain CDR1 are shown in SEQ ID NOs: 1340 and 1339, respectively;

the amino acid sequence and the nucleotide sequence of the L-chain CDR2 are shown in SEQ ID NOs: 1342 and 1341, respectively;

the amino acid sequence and the nucleotide sequence of the L-chain CDR3 are shown in SEQ ID NOs: 1344 and 1343, respectively.

For the IR-094 antibody of the present invention:

the amino acid sequence and the nucleotide sequence of the H-chain variable region (VH) are shown in SEQ ID NOs: 2626 and 2625, respectively;

the amino acid sequence and the nucleotide sequence of the L-chain variable region (VL) are shown in SEQ ID NOs: 2628 and 2627, respectively;

the amino acid sequence and the nucleotide sequence of the H-chain CDR1 are shown in SEQ ID NOs: 1350 and 1349, respectively;

the amino acid sequence and the nucleotide sequence of the H-chain CDR2 are shown in SEQ ID NOs: 1352 and 1351, respectively;

the amino acid sequence and the nucleotide sequence of the H-chain CDR3 are shown in SEQ ID NOs: 1354 and 1353, respectively;

the amino acid sequence and the nucleotide sequence of the L-chain CDR1 are shown in SEQ ID NOs: 1356 and 1355, respectively;

the amino acid sequence and the nucleotide sequence of the L-chain CDR2 are shown in SEQ ID NOs: 1358 and 1357, respectively;

the amino acid sequence and the nucleotide sequence of the L-chain CDR3 are shown in SEQ ID NOs: 1360 and 1359, respectively.

For the IR-095 antibody of the present invention:

the amino acid sequence and the nucleotide sequence of the H-chain variable region (VH) are shown in SEQ ID NOs: 2630 and 2629, respectively;

the amino acid sequence and the nucleotide sequence of the L-chain variable region (VL) are shown in SEQ ID NOs: 2632 and 2631, respectively;

the amino acid sequence and the nucleotide sequence of the H-chain CDR1 are shown in SEQ ID NOs: 1366 and 1365, respectively;

the amino acid sequence and the nucleotide sequence of the H-chain CDR2 are shown in SEQ ID NOs: 1368 and 1367, respectively;

the amino acid sequence and the nucleotide sequence of the H-chain CDR3 are shown in SEQ ID NOs: 1370 and 1369, respectively;

the amino acid sequence and the nucleotide sequence of the L-chain CDR1 are shown in SEQ ID NOs: 1372 and 1371, respectively;

the amino acid sequence and the nucleotide sequence of the L-chain CDR2 are shown in SEQ ID NOs: 1374 and 1373, respectively;

the amino acid sequence and the nucleotide sequence of the L-chain CDR3 are shown in SEQ ID NOs: 1376 and 1375, respectively.

For the IR-097 antibody of the present invention:

the amino acid sequence and the nucleotide sequence of the H-chain variable region (VH) are shown in SEQ ID NOs: 2634 and 2633, respectively;

the amino acid sequence and the nucleotide sequence of the L-chain variable region (VL) are shown in SEQ ID NOs: 2636 and 2635, respectively;

the amino acid sequence and the nucleotide sequence of the H-chain CDR1 are shown in SEQ ID NOs: 1382 and 1381, respectively;

the amino acid sequence and the nucleotide sequence of the H-chain CDR2 are shown in SEQ ID NOs: 1384 and 1383, respectively;

the amino acid sequence and the nucleotide sequence of the H-chain CDR3 are shown in SEQ ID NOs: 1386 and 1385, respectively;

the amino acid sequence and the nucleotide sequence of the L-chain CDR1 are shown in SEQ ID NOs: 1388 and 1387, respectively;

the amino acid sequence and the nucleotide sequence of the L-chain CDR2 are shown in SEQ ID NOs: 1390 and 1389, respectively;

the amino acid sequence and the nucleotide sequence of the L-chain CDR3 are shown in SEQ ID NOs: 1392 and 1391, respectively.

For the IR-098 antibody of the present invention:

the amino acid sequence and the nucleotide sequence of the H-chain variable region (VH) are shown in SEQ ID NOs: 2638 and 2637, respectively;

the amino acid sequence and the nucleotide sequence of the L-chain variable region (VL) are shown in SEQ ID NOs: 2640 and 2639, respectively;

the amino acid sequence and the nucleotide sequence of the H-chain CDR1 are shown in SEQ ID NOs: 1398 and 1397, respectively;

the amino acid sequence and the nucleotide sequence of the H-chain CDR2 are shown in SEQ ID NOs: 1400 and 1399, respectively;

the amino acid sequence and the nucleotide sequence of the H-chain CDR3 are shown in SEQ ID NOs: 1402 and 1401, respectively;

the amino acid sequence and the nucleotide sequence of the L-chain CDR1 are shown in SEQ ID NOs: 1404 and 1403, respectively;

the amino acid sequence and the nucleotide sequence of the L-chain CDR2 are shown in SEQ ID NOs: 1406 and 1405, respectively;

the amino acid sequence and the nucleotide sequence of the L-chain CDR3 are shown in SEQ ID NOs: 1408 and 1407, respectively.

For the IR-100 antibody of the present invention:

the amino acid sequence and the nucleotide sequence of the H-chain variable region (VH) are shown in SEQ ID NOs: 2642 and 2641, respectively;

the amino acid sequence and the nucleotide sequence of the L-chain variable region (VL) are shown in SEQ ID NOs: 2644 and 2643, respectively;

the amino acid sequence and the nucleotide sequence of the H-chain CDR1 are shown in SEQ ID NOs: 1414 and 1413, respectively;

the amino acid sequence and the nucleotide sequence of the H-chain CDR2 are shown in SEQ ID NOs: 1416 and 1415, respectively;

the amino acid sequence and the nucleotide sequence of the H-chain CDR3 are shown in SEQ ID NOs: 1418 and 1417, respectively;

the amino acid sequence and the nucleotide sequence of the L-chain CDR1 are shown in SEQ ID NOs: 1420 and 1419, respectively;

the amino acid sequence and the nucleotide sequence of the L-chain CDR2 are shown in SEQ ID NOs: 1422 and 1421, respectively;

the amino acid sequence and the nucleotide sequence of the L-chain CDR3 are shown in SEQ ID NOs: 1424 and 1423, respectively.

For the IR-101 antibody of the present invention:

the amino acid sequence and the nucleotide sequence of the H-chain variable region (VH) are shown in SEQ ID NOs: 2646 and 2645, respectively;

the amino acid sequence and the nucleotide sequence of the L-chain variable region (VL) are shown in SEQ ID NOs: 2648 and 2647, respectively;

the amino acid sequence and the nucleotide sequence of the H-chain CDR1 are shown in SEQ ID NOs: 1430 and 1429, respectively;

the amino acid sequence and the nucleotide sequence of the H-chain CDR2 are shown in SEQ ID NOs: 1432 and 1431, respectively;

the amino acid sequence and the nucleotide sequence of the H-chain CDR3 are shown in SEQ ID NOs: 1434 and 1433, respectively;

the amino acid sequence and the nucleotide sequence of the L-chain CDR1 are shown in SEQ ID NOs: 1436 and 1435, respectively;

the amino acid sequence and the nucleotide sequence of the L-chain CDR2 are shown in SEQ ID NOs: 1438 and 1437, respectively;

the amino acid sequence and the nucleotide sequence of the L-chain CDR3 are shown in SEQ ID NOs: 1440 and 1439, respectively.

For the IR-102 antibody of the present invention:

the amino acid sequence and the nucleotide sequence of the H-chain variable region (VH) are shown in SEQ ID NOs: 2650 and 2649, respectively;

the amino acid sequence and the nucleotide sequence of the L-chain variable region (VL) are shown in SEQ ID NOs: 2652 and 2651, respectively;

the amino acid sequence and the nucleotide sequence of the H-chain CDR1 are shown in SEQ ID NOs: 1446 and 1445, respectively;

the amino acid sequence and the nucleotide sequence of the H-chain CDR2 are shown in SEQ ID NOs: 1448 and 1447, respectively;

the amino acid sequence and the nucleotide sequence of the H-chain CDR3 are shown in SEQ ID NOs: 1450 and 1449, respectively;

the amino acid sequence and the nucleotide sequence of the L-chain CDR1 are shown in SEQ ID NOs: 1452 and 1451, respectively;

the amino acid sequence and the nucleotide sequence of the L-chain CDR2 are shown in SEQ ID NOs: 1454 and 1453, respectively;

the amino acid sequence and the nucleotide sequence of the L-chain CDR3 are shown in SEQ ID NOs: 1456 and 1455, respectively.

For the IR-104 antibody of the present invention:

the amino acid sequence and the nucleotide sequence of the H-chain variable region (VH) are shown in SEQ ID NOs: 2654 and 2653, respectively;

the amino acid sequence and the nucleotide sequence of the L-chain variable region (VL) are shown in SEQ ID NOs: 2656 and 2655, respectively;

the amino acid sequence and the nucleotide sequence of the H-chain CDR1 are shown in SEQ ID NOs: 1462 and 1461, respectively;

the amino acid sequence and the nucleotide sequence of the H-chain CDR2 are shown in SEQ ID NOs: 1464 and 1463, respectively;

the amino acid sequence and the nucleotide sequence of the H-chain CDR3 are shown in SEQ ID NOs: 1466 and 1465, respectively;

the amino acid sequence and the nucleotide sequence of the L-chain CDR1 are shown in SEQ ID NOs: 1468 and 1467, respectively;

the amino acid sequence and the nucleotide sequence of the L-chain CDR2 are shown in SEQ ID NOs: 1470 and 1469, respectively;

the amino acid sequence and the nucleotide sequence of the L-chain CDR3 are shown in SEQ ID NOs: 1472 and 1471, respectively.

For the IR-105 antibody of the present invention:

the amino acid sequence and the nucleotide sequence of the H-chain variable region (VH) are shown in SEQ ID NOs: 2658 and 2657, respectively;

the amino acid sequence and the nucleotide sequence of the L-chain variable region (VL) are shown in SEQ ID NOs: 2660 and 2659, respectively;

the amino acid sequence and the nucleotide sequence of the H-chain CDR1 are shown in SEQ ID NOs: 1478 and 1477, respectively;

the amino acid sequence and the nucleotide sequence of the H-chain CDR2 are shown in SEQ ID NOs: 1480 and 1479, respectively;

the amino acid sequence and the nucleotide sequence of the H-chain CDR3 are shown in SEQ ID NOs: 1482 and 1481, respectively;

the amino acid sequence and the nucleotide sequence of the L-chain CDR1 are shown in SEQ ID NOs: 1484 and 1483, respectively;

the amino acid sequence and the nucleotide sequence of the L-chain CDR2 are shown in SEQ ID NOs: 1486 and 1485, respectively;

the amino acid sequence and the nucleotide sequence of the L-chain CDR3 are shown in SEQ ID NOs: 1488 and 1487, respectively.

For the IR-106 antibody of the present invention:

the amino acid sequence and the nucleotide sequence of the H-chain variable region (VH) are shown in SEQ ID NOs: 2662 and 2661, respectively;

the amino acid sequence and the nucleotide sequence of the L-chain variable region (VL) are shown in SEQ ID NOs: 2664 and 2663, respectively;

the amino acid sequence and the nucleotide sequence of the H-chain CDR1 are shown in SEQ ID NOs: 1494 and 1493, respectively;

the amino acid sequence and the nucleotide sequence of the H-chain CDR2 are shown in SEQ ID NOs: 1496 and 1495, respectively;

the amino acid sequence and the nucleotide sequence of the H-chain CDR3 are shown in SEQ ID NOs: 1498 and 1497, respectively;

the amino acid sequence and the nucleotide sequence of the L-chain CDR1 are shown in SEQ ID NOs: 1500 and 1499, respectively;

the amino acid sequence and the nucleotide sequence of the L-chain CDR2 are shown in SEQ ID NOs: 1502 and 1501, respectively;

the amino acid sequence and the nucleotide sequence of the L-chain CDR3 are shown in SEQ ID NOs: 1504 and 1503, respectively.

For the IR-107 antibody of the present invention:

the amino acid sequence and the nucleotide sequence of the H-chain variable region (VH) are shown in SEQ ID NOs: 2666 and 2665, respectively;

the amino acid sequence and the nucleotide sequence of the L-chain variable region (VL) are shown in SEQ ID NOs: 2668 and 2667, respectively;

the amino acid sequence and the nucleotide sequence of the H-chain CDR1 are shown in SEQ ID NOs: 1510 and 1509, respectively;

the amino acid sequence and the nucleotide sequence of the H-chain CDR2 are shown in SEQ ID NOs: 1512 and 1511, respectively;

the amino acid sequence and the nucleotide sequence of the H-chain CDR3 are shown in SEQ ID NOs: 1514 and 1513, respectively;

the amino acid sequence and the nucleotide sequence of the L-chain CDR1 are shown in SEQ ID NOs: 1516 and 1515, respectively;

the amino acid sequence and the nucleotide sequence of the L-chain CDR2 are shown in SEQ ID NOs: 1518 and 1517, respectively;

the amino acid sequence and the nucleotide sequence of the L-chain CDR3 are shown in SEQ ID NOs: 1520 and 1519, respectively.

For the IR-108 antibody of the present invention:

the amino acid sequence and the nucleotide sequence of the H-chain variable region (VH) are shown in SEQ ID NOs: 2670 and 2669, respectively;

the amino acid sequence and the nucleotide sequence of the L-chain variable region (VL) are shown in SEQ ID NOs: 2672 and 2671, respectively;

the amino acid sequence and the nucleotide sequence of the H-chain CDR1 are shown in SEQ ID NOs: 1526 and 1525, respectively;

the amino acid sequence and the nucleotide sequence of the H-chain CDR2 are shown in SEQ ID NOs: 1528 and 1527, respectively;

the amino acid sequence and the nucleotide sequence of the H-chain CDR3 are shown in SEQ ID NOs: 1530 and 1529, respectively;

the amino acid sequence and the nucleotide sequence of the L-chain CDR1 are shown in SEQ ID NOs: 1532 and 1531, respectively;

the amino acid sequence and the nucleotide sequence of the L-chain CDR2 are shown in SEQ ID NOs: 1534 and 1533, respectively;

the amino acid sequence and the nucleotide sequence of the L-chain CDR3 are shown in SEQ ID NOs: 1536 and 1535, respectively.

For the IR-109 antibody of the present invention:
the amino acid sequence and the nucleotide sequence of the H-chain variable region (VH) are shown in SEQ ID NOs: 2674 and 2673, respectively;
the amino acid sequence and the nucleotide sequence of the L-chain variable region (VL) are shown in SEQ ID NOs: 2676 and 2675, respectively;
the amino acid sequence and the nucleotide sequence of the H-chain CDR1 are shown in SEQ ID NOs: 1542 and 1541, respectively;
the amino acid sequence and the nucleotide sequence of the H-chain CDR2 are shown in SEQ ID NOs: 1544 and 1543, respectively;
the amino acid sequence and the nucleotide sequence of the H-chain CDR3 are shown in SEQ ID NOs: 1546 and 1545, respectively;
the amino acid sequence and the nucleotide sequence of the L-chain CDR1 are shown in SEQ ID NOs: 1548 and 1547, respectively;
the amino acid sequence and the nucleotide sequence of the L-chain CDR2 are shown in SEQ ID NOs: 1550 and 1549, respectively;
the amino acid sequence and the nucleotide sequence of the L-chain CDR3 are shown in SEQ ID NOs: 1552 and 1551, respectively.

For the IR-110 antibody of the present invention:
the amino acid sequence and the nucleotide sequence of the H-chain variable region (VH) are shown in SEQ ID NOs: 2678 and 2677, respectively;
the amino acid sequence and the nucleotide sequence of the L-chain variable region (VL) are shown in SEQ ID NOs: 2680 and 2679, respectively;
the amino acid sequence and the nucleotide sequence of the H-chain CDR1 are shown in SEQ ID NOs: 1558 and 1557, respectively;
the amino acid sequence and the nucleotide sequence of the H-chain CDR2 are shown in SEQ ID NOs: 1560 and 1559, respectively;
the amino acid sequence and the nucleotide sequence of the H-chain CDR3 are shown in SEQ ID NOs: 1562 and 1561, respectively;
the amino acid sequence and the nucleotide sequence of the L-chain CDR1 are shown in SEQ ID NOs: 1564 and 1563, respectively;
the amino acid sequence and the nucleotide sequence of the L-chain CDR2 are shown in SEQ ID NOs: 1566 and 1565, respectively;
the amino acid sequence and the nucleotide sequence of the L-chain CDR3 are shown in SEQ ID NOs: 1568 and 1567, respectively.

For the IR-112 antibody of the present invention:
the amino acid sequence and the nucleotide sequence of the H-chain variable region (VH) are shown in SEQ ID NOs: 2682 and 2681, respectively;
the amino acid sequence and the nucleotide sequence of the L-chain variable region (VL) are shown in SEQ ID NOs: 2684 and 2683, respectively;
the amino acid sequence and the nucleotide sequence of the H-chain CDR1 are shown in SEQ ID NOs: 1574 and 1573, respectively;
the amino acid sequence and the nucleotide sequence of the H-chain CDR2 are shown in SEQ ID NOs: 1576 and 1575, respectively;
the amino acid sequence and the nucleotide sequence of the H-chain CDR3 are shown in SEQ ID NOs: 1578 and 1577, respectively;
the amino acid sequence and the nucleotide sequence of the L-chain CDR1 are shown in SEQ ID NOs: 1580 and 1579, respectively;
the amino acid sequence and the nucleotide sequence of the L-chain CDR2 are shown in SEQ ID NOs: 1582 and 1581, respectively;
the amino acid sequence and the nucleotide sequence of the L-chain CDR3 are shown in SEQ ID NOs: 1584 and 1583, respectively.

For the IR-114 antibody of the present invention:
the amino acid sequence and the nucleotide sequence of the H-chain variable region (VH) are shown in SEQ ID NOs: 2686 and 2685, respectively;
the amino acid sequence and the nucleotide sequence of the L-chain variable region (VL) are shown in SEQ ID NOs: 2688 and 2687, respectively;
the amino acid sequence and the nucleotide sequence of the H-chain CDR1 are shown in SEQ ID NOs: 1590 and 1589, respectively;
the amino acid sequence and the nucleotide sequence of the H-chain CDR2 are shown in SEQ ID NOs: 1592 and 1591, respectively;
the amino acid sequence and the nucleotide sequence of the H-chain CDR3 are shown in SEQ ID NOs: 1594 and 1593, respectively;
the amino acid sequence and the nucleotide sequence of the L-chain CDR1 are shown in SEQ ID NOs: 1596 and 1595, respectively;
the amino acid sequence and the nucleotide sequence of the L-chain CDR2 are shown in SEQ ID NOs: 1598 and 1597, respectively;
the amino acid sequence and the nucleotide sequence of the L-chain CDR3 are shown in SEQ ID NOs: 1600 and 1599, respectively.

For the IR-115 antibody of the present invention:
the amino acid sequence and the nucleotide sequence of the H-chain variable region (VH) are shown in SEQ ID NOs: 2690 and 2689, respectively;
the amino acid sequence and the nucleotide sequence of the L-chain variable region (VL) are shown in SEQ ID NOs: 2692 and 2691, respectively;
the amino acid sequence and the nucleotide sequence of the H-chain CDR1 are shown in SEQ ID NOs: 1606 and 1605, respectively;
the amino acid sequence and the nucleotide sequence of the H-chain CDR2 are shown in SEQ ID NOs: 1608 and 1607, respectively;
the amino acid sequence and the nucleotide sequence of the H-chain CDR3 are shown in SEQ ID NOs: 1610 and 1609, respectively;
the amino acid sequence and the nucleotide sequence of the L-chain CDR1 are shown in SEQ ID NOs: 1612 and 1611, respectively;
the amino acid sequence and the nucleotide sequence of the L-chain CDR2 are shown in SEQ ID NOs: 1614 and 1613, respectively;
the amino acid sequence and the nucleotide sequence of the L-chain CDR3 are shown in SEQ ID NOs: 1616 and 1615, respectively.

For the IR-116 antibody of the present invention:
the amino acid sequence and the nucleotide sequence of the H-chain variable region (VH) are shown in SEQ ID NOs: 2694 and 2693, respectively;

the amino acid sequence and the nucleotide sequence of the L-chain variable region (VL) are shown in SEQ ID NOs: 2696 and 2695, respectively;

the amino acid sequence and the nucleotide sequence of the H-chain CDR1 are shown in SEQ ID NOs: 1622 and 1621, respectively;

the amino acid sequence and the nucleotide sequence of the H-chain CDR2 are shown in SEQ ID NOs: 1624 and 1623, respectively;

the amino acid sequence and the nucleotide sequence of the H-chain CDR3 are shown in SEQ ID NOs: 1626 and 1625, respectively;

the amino acid sequence and the nucleotide sequence of the L-chain CDR1 are shown in SEQ ID NOs: 1628 and 1627, respectively;

the amino acid sequence and the nucleotide sequence of the L-chain CDR2 are shown in SEQ ID NOs: 1630 and 1629, respectively;

the amino acid sequence and the nucleotide sequence of the L-chain CDR3 are shown in SEQ ID NOs: 1632 and 1631, respectively.

For the IR-117 antibody of the present invention:

the amino acid sequence and the nucleotide sequence of the H-chain variable region (VH) are shown in SEQ ID NOs: 2698 and 2697, respectively;

the amino acid sequence and the nucleotide sequence of the L-chain variable region (VL) are shown in SEQ ID NOs: 2700 and 2699, respectively;

the amino acid sequence and the nucleotide sequence of the H-chain CDR1 are shown in SEQ ID NOs: 1638 and 1637, respectively;

the amino acid sequence and the nucleotide sequence of the H-chain CDR2 are shown in SEQ ID NOs: 1640 and 1639, respectively;

the amino acid sequence and the nucleotide sequence of the H-chain CDR3 are shown in SEQ ID NOs: 1642 and 1641, respectively;

the amino acid sequence and the nucleotide sequence of the L-chain CDR1 are shown in SEQ ID NOs: 1644 and 1643, respectively;

the amino acid sequence and the nucleotide sequence of the L-chain CDR2 are shown in SEQ ID NOs: 1646 and 1645, respectively;

the amino acid sequence and the nucleotide sequence of the L-chain CDR3 are shown in SEQ ID NOs: 1648 and 1647, respectively.

For the IR-118 antibody of the present invention:

the amino acid sequence and the nucleotide sequence of the H-chain variable region (VH) are shown in SEQ ID NOs: 2702 and 2701, respectively;

the amino acid sequence and the nucleotide sequence of the L-chain variable region (VL) are shown in SEQ ID NOs: 2704 and 2703, respectively;

the amino acid sequence and the nucleotide sequence of the H-chain CDR1 are shown in SEQ ID NOs: 1654 and 1653, respectively;

the amino acid sequence and the nucleotide sequence of the H-chain CDR2 are shown in SEQ ID NOs: 1656 and 1655, respectively;

the amino acid sequence and the nucleotide sequence of the H-chain CDR3 are shown in SEQ ID NOs: 1658 and 1657, respectively;

the amino acid sequence and the nucleotide sequence of the L-chain CDR1 are shown in SEQ ID NOs: 1660 and 1659, respectively;

the amino acid sequence and the nucleotide sequence of the L-chain CDR2 are shown in SEQ ID NOs: 1662 and 1661, respectively;

the amino acid sequence and the nucleotide sequence of the L-chain CDR3 are shown in SEQ ID NOs: 1664 and 1663, respectively.

For the IR-119 antibody of the present invention:

the amino acid sequence and the nucleotide sequence of the H-chain variable region (VH) are shown in SEQ ID NOs: 2706 and 2705, respectively;

the amino acid sequence and the nucleotide sequence of the L-chain variable region (VL) are shown in SEQ ID NOs: 2708 and 2707, respectively;

the amino acid sequence and the nucleotide sequence of the H-chain CDR1 are shown in SEQ ID NOs: 1670 and 1669, respectively;

the amino acid sequence and the nucleotide sequence of the H-chain CDR2 are shown in SEQ ID NOs: 1672 and 1671, respectively;

the amino acid sequence and the nucleotide sequence of the H-chain CDR3 are shown in SEQ ID NOs: 1674 and 1673, respectively;

the amino acid sequence and the nucleotide sequence of the L-chain CDR1 are shown in SEQ ID NOs: 1676 and 1675, respectively;

the amino acid sequence and the nucleotide sequence of the L-chain CDR2 are shown in SEQ ID NOs: 1678 and 1677, respectively;

the amino acid sequence and the nucleotide sequence of the L-chain CDR3 are shown in SEQ ID NOs: 1680 and 1679, respectively.

For the IR-120 antibody of the present invention:

the amino acid sequence and the nucleotide sequence of the H-chain variable region (VH) are shown in SEQ ID NOs: 2710 and 2709, respectively;

the amino acid sequence and the nucleotide sequence of the L-chain variable region (VL) are shown in SEQ ID NOs: 2712 and 2711, respectively;

the amino acid sequence and the nucleotide sequence of the H-chain CDR1 are shown in SEQ ID NOs: 1686 and 1685, respectively;

the amino acid sequence and the nucleotide sequence of the H-chain CDR2 are shown in SEQ ID NOs: 1688 and 1687, respectively;

the amino acid sequence and the nucleotide sequence of the H-chain CDR3 are shown in SEQ ID NOs: 1690 and 1689, respectively;

the amino acid sequence and the nucleotide sequence of the L-chain CDR1 are shown in SEQ ID NOs: 1692 and 1691, respectively;

the amino acid sequence and the nucleotide sequence of the L-chain CDR2 are shown in SEQ ID NOs: 1694 and 1693, respectively;

the amino acid sequence and the nucleotide sequence of the L-chain CDR3 are shown in SEQ ID NOs: 1696 and 1695, respectively.

For the IR-121 antibody of the present invention:

the amino acid sequence and the nucleotide sequence of the H-chain variable region (VH) are shown in SEQ ID NOs: 2714 and 2713, respectively;

the amino acid sequence and the nucleotide sequence of the L-chain variable region (VL) are shown in SEQ ID NOs: 2716 and 2715, respectively;

the amino acid sequence and the nucleotide sequence of the H-chain CDR1 are shown in SEQ ID NOs: 1702 and 1701, respectively;

the amino acid sequence and the nucleotide sequence of the H-chain CDR2 are shown in SEQ ID NOs: 1704 and 1703, respectively;

the amino acid sequence and the nucleotide sequence of the H-chain CDR3 are shown in SEQ ID NOs: 1706 and 1705, respectively;

the amino acid sequence and the nucleotide sequence of the L-chain CDR1 are shown in SEQ ID NOs: 1708 and 1707, respectively;

the amino acid sequence and the nucleotide sequence of the L-chain CDR2 are shown in SEQ ID NOs: 1710 and 1709, respectively;

the amino acid sequence and the nucleotide sequence of the L-chain CDR3 are shown in SEQ ID NOs: 1712 and 1711, respectively.

For the IR-122 antibody of the present invention:

the amino acid sequence and the nucleotide sequence of the H-chain variable region (VH) are shown in SEQ ID NOs: 2718 and 2717, respectively;

the amino acid sequence and the nucleotide sequence of the L-chain variable region (VL) are shown in SEQ ID NOs: 2720 and 2719, respectively;

the amino acid sequence and the nucleotide sequence of the H-chain CDR1 are shown in SEQ ID NOs: 1718 and 1717, respectively;

the amino acid sequence and the nucleotide sequence of the H-chain CDR2 are shown in SEQ ID NOs: 1720 and 1719, respectively;

the amino acid sequence and the nucleotide sequence of the H-chain CDR3 are shown in SEQ ID NOs: 1722 and 1721, respectively;

the amino acid sequence and the nucleotide sequence of the L-chain CDR1 are shown in SEQ ID NOs: 1724 and 1723, respectively;

the amino acid sequence and the nucleotide sequence of the L-chain CDR2 are shown in SEQ ID NOs: 1726 and 1725, respectively;

the amino acid sequence and the nucleotide sequence of the L-chain CDR3 are shown in SEQ ID NOs: 1728 and 1727, respectively.

For the IR-123 antibody of the present invention:

the amino acid sequence and the nucleotide sequence of the H-chain variable region (VH) are shown in SEQ ID NOs: 2722 and 2721, respectively;

the amino acid sequence and the nucleotide sequence of the L-chain variable region (VL) are shown in SEQ ID NOs: 2724 and 2723, respectively;

the amino acid sequence and the nucleotide sequence of the H-chain CDR1 are shown in SEQ ID NOs: 1734 and 1733, respectively;

the amino acid sequence and the nucleotide sequence of the H-chain CDR2 are shown in SEQ ID NOs: 1736 and 1735, respectively;

the amino acid sequence and the nucleotide sequence of the H-chain CDR3 are shown in SEQ ID NOs: 1738 and 1737, respectively;

the amino acid sequence and the nucleotide sequence of the L-chain CDR1 are shown in SEQ ID NOs: 1740 and 1739, respectively;

the amino acid sequence and the nucleotide sequence of the L-chain CDR2 are shown in SEQ ID NOs: 1742 and 1741, respectively;

the amino acid sequence and the nucleotide sequence of the L-chain CDR3 are shown in SEQ ID NOs: 1744 and 1743, respectively.

For the IR-124 antibody of the present invention:

the amino acid sequence and the nucleotide sequence of the H-chain variable region (VH) are shown in SEQ ID NOs: 2726 and 2725, respectively;

the amino acid sequence and the nucleotide sequence of the L-chain variable region (VL) are shown in SEQ ID NOs: 2728 and 2727, respectively;

the amino acid sequence and the nucleotide sequence of the H-chain CDR1 are shown in SEQ ID NOs: 1750 and 1749, respectively;

the amino acid sequence and the nucleotide sequence of the H-chain CDR2 are shown in SEQ ID NOs: 1752 and 1751, respectively;

the amino acid sequence and the nucleotide sequence of the H-chain CDR3 are shown in SEQ ID NOs: 1754 and 1753, respectively;

the amino acid sequence and the nucleotide sequence of the L-chain CDR1 are shown in SEQ ID NOs: 1756 and 1755, respectively;

the amino acid sequence and the nucleotide sequence of the L-chain CDR2 are shown in SEQ ID NOs: 1758 and 1757, respectively;

the amino acid sequence and the nucleotide sequence of the L-chain CDR3 are shown in SEQ ID NOs: 1760 and 1759, respectively.

For the IR-125 antibody of the present invention:

the amino acid sequence and the nucleotide sequence of the H-chain variable region (VH) are shown in SEQ ID NOs: 2730 and 2729, respectively;

the amino acid sequence and the nucleotide sequence of the L-chain variable region (VL) are shown in SEQ ID NOs: 2732 and 2731, respectively;

the amino acid sequence and the nucleotide sequence of the H-chain CDR1 are shown in SEQ ID NOs: 1766 and 1765, respectively;

the amino acid sequence and the nucleotide sequence of the H-chain CDR2 are shown in SEQ ID NOs: 1768 and 1767, respectively;

the amino acid sequence and the nucleotide sequence of the H-chain CDR3 are shown in SEQ ID NOs: 1770 and 1769, respectively;

the amino acid sequence and the nucleotide sequence of the L-chain CDR1 are shown in SEQ ID NOs: 1772 and 1771, respectively;

the amino acid sequence and the nucleotide sequence of the L-chain CDR2 are shown in SEQ ID NOs: 1774 and 1773, respectively;

the amino acid sequence and the nucleotide sequence of the L-chain CDR3 are shown in SEQ ID NOs: 1776 and 1775, respectively.

For the IR-126 antibody of the present invention:

the amino acid sequence and the nucleotide sequence of the H-chain variable region (VH) are shown in SEQ ID NOs: 2734 and 2733, respectively;

the amino acid sequence and the nucleotide sequence of the L-chain variable region (VL) are shown in SEQ ID NOs: 2736 and 2735, respectively;

the amino acid sequence and the nucleotide sequence of the H-chain CDR1 are shown in SEQ ID NOs: 1782 and 1781, respectively;

the amino acid sequence and the nucleotide sequence of the H-chain CDR2 are shown in SEQ ID NOs: 1784 and 1783, respectively;

the amino acid sequence and the nucleotide sequence of the H-chain CDR3 are shown in SEQ ID NOs: 1786 and 1785, respectively;

the amino acid sequence and the nucleotide sequence of the L-chain CDR1 are shown in SEQ ID NOs: 1788 and 1787, respectively;

the amino acid sequence and the nucleotide sequence of the L-chain CDR2 are shown in SEQ ID NOs: 1790 and 1789, respectively;

the amino acid sequence and the nucleotide sequence of the L-chain CDR3 are shown in SEQ ID NOs: 1792 and 1791, respectively.

For the IR-127 antibody of the present invention:

the amino acid sequence and the nucleotide sequence of the H-chain variable region (VH) are shown in SEQ ID NOs: 2738 and 2737, respectively;

the amino acid sequence and the nucleotide sequence of the L-chain variable region (VL) are shown in SEQ ID NOs: 2740 and 2739, respectively;

the amino acid sequence and the nucleotide sequence of the H-chain CDR1 are shown in SEQ ID NOs: 1798 and 1797, respectively;

the amino acid sequence and the nucleotide sequence of the H-chain CDR2 are shown in SEQ ID NOs: 1800 and 1799, respectively;

the amino acid sequence and the nucleotide sequence of the H-chain CDR3 are shown in SEQ ID NOs: 1802 and 1801, respectively;

the amino acid sequence and the nucleotide sequence of the L-chain CDR1 are shown in SEQ ID NOs: 1804 and 1803, respectively;

the amino acid sequence and the nucleotide sequence of the L-chain CDR2 are shown in SEQ ID NOs: 1806 and 1805, respectively;

the amino acid sequence and the nucleotide sequence of the L-chain CDR3 are shown in SEQ ID NOs: 1808 and 1807, respectively.

For the IR-128 antibody of the present invention:

the amino acid sequence and the nucleotide sequence of the H-chain variable region (VH) are shown in SEQ ID NOs: 2742 and 2741, respectively;

the amino acid sequence and the nucleotide sequence of the L-chain variable region (VL) are shown in SEQ ID NOs: 2744 and 2743, respectively;

the amino acid sequence and the nucleotide sequence of the H-chain CDR1 are shown in SEQ ID NOs: 1814 and 1813, respectively;

the amino acid sequence and the nucleotide sequence of the H-chain CDR2 are shown in SEQ ID NOs: 1816 and 1815, respectively;

the amino acid sequence and the nucleotide sequence of the H-chain CDR3 are shown in SEQ ID NOs: 1818 and 1817, respectively;

the amino acid sequence and the nucleotide sequence of the L-chain CDR1 are shown in SEQ ID NOs: 1820 and 1819, respectively;

the amino acid sequence and the nucleotide sequence of the L-chain CDR2 are shown in SEQ ID NOs: 1822 and 1821, respectively;

the amino acid sequence and the nucleotide sequence of the L-chain CDR3 are shown in SEQ ID NOs: 1824 and 1823, respectively.

For the IR-129 antibody of the present invention:

the amino acid sequence and the nucleotide sequence of the H-chain variable region (VH) are shown in SEQ ID NOs: 2746 and 2745, respectively;

the amino acid sequence and the nucleotide sequence of the L-chain variable region (VL) are shown in SEQ ID NOs: 2748 and 2747, respectively;

the amino acid sequence and the nucleotide sequence of the H-chain CDR1 are shown in SEQ ID NOs: 1830 and 1829, respectively;

the amino acid sequence and the nucleotide sequence of the H-chain CDR2 are shown in SEQ ID NOs: 1832 and 1831, respectively;

the amino acid sequence and the nucleotide sequence of the H-chain CDR3 are shown in SEQ ID NOs: 1834 and 1833, respectively;

the amino acid sequence and the nucleotide sequence of the L-chain CDR1 are shown in SEQ ID NOs: 1836 and 1835, respectively;

the amino acid sequence and the nucleotide sequence of the L-chain CDR2 are shown in SEQ ID NOs: 1838 and 1837, respectively;

the amino acid sequence and the nucleotide sequence of the L-chain CDR3 are shown in SEQ ID NOs: 1840 and 1839, respectively.

For the IR-131 antibody of the present invention:

the amino acid sequence and the nucleotide sequence of the H-chain variable region (VH) are shown in SEQ ID NOs: 2750 and 2749, respectively;

the amino acid sequence and the nucleotide sequence of the L-chain variable region (VL) are shown in SEQ ID NOs: 2752 and 2751, respectively;

the amino acid sequence and the nucleotide sequence of the H-chain CDR1 are shown in SEQ ID NOs: 1846 and 1845, respectively;

the amino acid sequence and the nucleotide sequence of the H-chain CDR2 are shown in SEQ ID NOs: 1848 and 1847, respectively;

the amino acid sequence and the nucleotide sequence of the H-chain CDR3 are shown in SEQ ID NOs: 1850 and 1849, respectively;

the amino acid sequence and the nucleotide sequence of the L-chain CDR1 are shown in SEQ ID NOs: 1852 and 1851, respectively;

the amino acid sequence and the nucleotide sequence of the L-chain CDR2 are shown in SEQ ID NOs: 1854 and 1853, respectively;

the amino acid sequence and the nucleotide sequence of the L-chain CDR3 are shown in SEQ ID NOs: 1856 and 1855, respectively.

For the IR-132 antibody of the present invention:

the amino acid sequence and the nucleotide sequence of the H-chain variable region (VH) are shown in SEQ ID NOs: 2754 and 2753, respectively;

the amino acid sequence and the nucleotide sequence of the L-chain variable region (VL) are shown in SEQ ID NOs: 2756 and 2755, respectively;

the amino acid sequence and the nucleotide sequence of the H-chain CDR1 are shown in SEQ ID NOs: 1862 and 1861, respectively;

the amino acid sequence and the nucleotide sequence of the H-chain CDR2 are shown in SEQ ID NOs: 1864 and 1863, respectively;

the amino acid sequence and the nucleotide sequence of the H-chain CDR3 are shown in SEQ ID NOs: 1866 and 1865, respectively;

the amino acid sequence and the nucleotide sequence of the L-chain CDR1 are shown in SEQ ID NOs: 1868 and 1867, respectively;

the amino acid sequence and the nucleotide sequence of the L-chain CDR2 are shown in SEQ ID NOs: 1870 and 1869, respectively;

the amino acid sequence and the nucleotide sequence of the L-chain CDR3 are shown in SEQ ID NOs: 1872 and 1871, respectively.

For the IR-133 antibody of the present invention:
the amino acid sequence and the nucleotide sequence of the H-chain variable region (VH) are shown in SEQ ID NOs: 2758 and 2757, respectively;
the amino acid sequence and the nucleotide sequence of the L-chain variable region (VL) are shown in SEQ ID NOs: 2760 and 2759, respectively;
the amino acid sequence and the nucleotide sequence of the H-chain CDR1 are shown in SEQ ID NOs: 1878 and 1877, respectively;
the amino acid sequence and the nucleotide sequence of the H-chain CDR2 are shown in SEQ ID NOs: 1880 and 1879, respectively;
the amino acid sequence and the nucleotide sequence of the H-chain CDR3 are shown in SEQ ID NOs: 1882 and 1881, respectively;
the amino acid sequence and the nucleotide sequence of the L-chain CDR1 are shown in SEQ ID NOs: 1884 and 1883, respectively;
the amino acid sequence and the nucleotide sequence of the L-chain CDR2 are shown in SEQ ID NOs: 1886 and 1885, respectively;
the amino acid sequence and the nucleotide sequence of the L-chain CDR3 are shown in SEQ ID NOs: 1888 and 1887, respectively.

For the IR-134 antibody of the present invention:
the amino acid sequence and the nucleotide sequence of the H-chain variable region (VH) are shown in SEQ ID NOs: 2762 and 2761, respectively;
the amino acid sequence and the nucleotide sequence of the L-chain variable region (VL) are shown in SEQ ID NOs: 2764 and 2763, respectively;
the amino acid sequence and the nucleotide sequence of the H-chain CDR1 are shown in SEQ ID NOs: 1894 and 1893, respectively;
the amino acid sequence and the nucleotide sequence of the H-chain CDR2 are shown in SEQ ID NOs: 1896 and 1895, respectively;
the amino acid sequence and the nucleotide sequence of the H-chain CDR3 are shown in SEQ ID NOs: 1898 and 1897, respectively;
the amino acid sequence and the nucleotide sequence of the L-chain CDR1 are shown in SEQ ID NOs: 1900 and 1899, respectively;
the amino acid sequence and the nucleotide sequence of the L-chain CDR2 are shown in SEQ ID NOs: 1902 and 1901, respectively;
the amino acid sequence and the nucleotide sequence of the L-chain CDR3 are shown in SEQ ID NOs: 1904 and 1903, respectively.

For the IR-135 antibody of the present invention:
the amino acid sequence and the nucleotide sequence of the H-chain variable region (VH) are shown in SEQ ID NOs: 2766 and 2765, respectively;
the amino acid sequence and the nucleotide sequence of the L-chain variable region (VL) are shown in SEQ ID NOs: 2768 and 2767, respectively;
the amino acid sequence and the nucleotide sequence of the H-chain CDR1 are shown in SEQ ID NOs: 1910 and 1909, respectively;
the amino acid sequence and the nucleotide sequence of the H-chain CDR2 are shown in SEQ ID NOs: 1912 and 1911, respectively;
the amino acid sequence and the nucleotide sequence of the H-chain CDR3 are shown in SEQ ID NOs: 1914 and 1913, respectively;
the amino acid sequence and the nucleotide sequence of the L-chain CDR1 are shown in SEQ ID NOs: 1916 and 1915, respectively;
the amino acid sequence and the nucleotide sequence of the L-chain CDR2 are shown in SEQ ID NOs: 1918 and 1917, respectively;
the amino acid sequence and the nucleotide sequence of the L-chain CDR3 are shown in SEQ ID NOs: 1920 and 1919, respectively.

For the IR-136 antibody of the present invention:
the amino acid sequence and the nucleotide sequence of the H-chain variable region (VH) are shown in SEQ ID NOs: 2770 and 2769, respectively;
the amino acid sequence and the nucleotide sequence of the L-chain variable region (VL) are shown in SEQ ID NOs: 2772 and 2771, respectively;
the amino acid sequence and the nucleotide sequence of the H-chain CDR1 are shown in SEQ ID NOs: 1926 and 1925, respectively;
the amino acid sequence and the nucleotide sequence of the H-chain CDR2 are shown in SEQ ID NOs: 1928 and 1927, respectively;
the amino acid sequence and the nucleotide sequence of the H-chain CDR3 are shown in SEQ ID NOs: 1930 and 1929, respectively;
the amino acid sequence and the nucleotide sequence of the L-chain CDR1 are shown in SEQ ID NOs: 1932 and 1931, respectively;
the amino acid sequence and the nucleotide sequence of the L-chain CDR2 are shown in SEQ ID NOs: 1934 and 1933, respectively;
the amino acid sequence and the nucleotide sequence of the L-chain CDR3 are shown in SEQ ID NOs: 1936 and 1935, respectively.

For the IR-137 antibody of the present invention:
the amino acid sequence and the nucleotide sequence of the H-chain variable region (VH) are shown in SEQ ID NOs: 2774 and 2773, respectively;
the amino acid sequence and the nucleotide sequence of the L-chain variable region (VL) are shown in SEQ ID NOs: 2776 and 2775, respectively;
the amino acid sequence and the nucleotide sequence of the H-chain CDR1 are shown in SEQ ID NOs: 1942 and 1941, respectively;
the amino acid sequence and the nucleotide sequence of the H-chain CDR2 are shown in SEQ ID NOs: 1944 and 1943, respectively;
the amino acid sequence and the nucleotide sequence of the H-chain CDR3 are shown in SEQ ID NOs: 1946 and 1945, respectively;
the amino acid sequence and the nucleotide sequence of the L-chain CDR1 are shown in SEQ ID NOs: 1948 and 1947, respectively;
the amino acid sequence and the nucleotide sequence of the L-chain CDR2 are shown in SEQ ID NOs: 1950 and 1949, respectively;
the amino acid sequence and the nucleotide sequence of the L-chain CDR3 are shown in SEQ ID NOs: 1952 and 1951, respectively.

For the IR-138 antibody of the present invention:
the amino acid sequence and the nucleotide sequence of the H-chain variable region (VH) are shown in SEQ ID NOs: 2778 and 2777, respectively;

the amino acid sequence and the nucleotide sequence of the L-chain variable region (VL) are shown in SEQ ID NOs: 2780 and 2779, respectively;

the amino acid sequence and the nucleotide sequence of the H-chain CDR1 are shown in SEQ ID NOs: 1958 and 1957, respectively;

the amino acid sequence and the nucleotide sequence of the H-chain CDR2 are shown in SEQ ID NOs: 1960 and 1959, respectively;

the amino acid sequence and the nucleotide sequence of the H-chain CDR3 are shown in SEQ ID NOs: 1962 and 1961, respectively;

the amino acid sequence and the nucleotide sequence of the L-chain CDR1 are shown in SEQ ID NOs: 1964 and 1963, respectively;

the amino acid sequence and the nucleotide sequence of the L-chain CDR2 are shown in SEQ ID NOs: 1966 and 1965, respectively;

the amino acid sequence and the nucleotide sequence of the L-chain CDR3 are shown in SEQ ID NOs: 1968 and 1967, respectively.

For the IR-139 antibody of the present invention:

the amino acid sequence and the nucleotide sequence of the H-chain variable region (VH) are shown in SEQ ID NOs: 2782 and 2781, respectively;

the amino acid sequence and the nucleotide sequence of the L-chain variable region (VL) are shown in SEQ ID NOs: 2784 and 2783, respectively;

the amino acid sequence and the nucleotide sequence of the H-chain CDR1 are shown in SEQ ID NOs: 1974 and 1973, respectively;

the amino acid sequence and the nucleotide sequence of the H-chain CDR2 are shown in SEQ ID NOs: 1976 and 1975, respectively;

the amino acid sequence and the nucleotide sequence of the H-chain CDR3 are shown in SEQ ID NOs: 1978 and 1977, respectively;

the amino acid sequence and the nucleotide sequence of the L-chain CDR1 are shown in SEQ ID NOs: 1980 and 1979, respectively;

the amino acid sequence and the nucleotide sequence of the L-chain CDR2 are shown in SEQ ID NOs: 1982 and 1981, respectively;

the amino acid sequence and the nucleotide sequence of the L-chain CDR3 are shown in SEQ ID NOs: 1984 and 1983, respectively.

For the IR-140 antibody of the present invention:

the amino acid sequence and the nucleotide sequence of the H-chain variable region (VH) are shown in SEQ ID NOs: 2786 and 2785, respectively;

the amino acid sequence and the nucleotide sequence of the L-chain variable region (VL) are shown in SEQ ID NOs: 2788 and 2787, respectively;

the amino acid sequence and the nucleotide sequence of the H-chain CDR1 are shown in SEQ ID NOs: 1990 and 1989, respectively;

the amino acid sequence and the nucleotide sequence of the H-chain CDR2 are shown in SEQ ID NOs: 1992 and 1991, respectively;

the amino acid sequence and the nucleotide sequence of the H-chain CDR3 are shown in SEQ ID NOs: 1994 and 1993, respectively;

the amino acid sequence and the nucleotide sequence of the L-chain CDR1 are shown in SEQ ID NOs: 1996 and 1995, respectively;

the amino acid sequence and the nucleotide sequence of the L-chain CDR2 are shown in SEQ ID NOs: 1998 and 1997, respectively;

the amino acid sequence and the nucleotide sequence of the L-chain CDR3 are shown in SEQ ID NOs: 2000 and 1999, respectively.

For the IR-141 antibody of the present invention:

the amino acid sequence and the nucleotide sequence of the H-chain variable region (VH) are shown in SEQ ID NOs: 2790 and 2789, respectively;

the amino acid sequence and the nucleotide sequence of the L-chain variable region (VL) are shown in SEQ ID NOs: 2792 and 2791, respectively;

the amino acid sequence and the nucleotide sequence of the H-chain CDR1 are shown in SEQ ID NOs: 2006 and 2005, respectively;

the amino acid sequence and the nucleotide sequence of the H-chain CDR2 are shown in SEQ ID NOs: 2008 and 2007, respectively;

the amino acid sequence and the nucleotide sequence of the H-chain CDR3 are shown in SEQ ID NOs: 2010 and 2009, respectively;

the amino acid sequence and the nucleotide sequence of the L-chain CDR1 are shown in SEQ ID NOs: 2012 and 2011, respectively;

the amino acid sequence and the nucleotide sequence of the L-chain CDR2 are shown in SEQ ID NOs: 2014 and 2013, respectively;

the amino acid sequence and the nucleotide sequence of the L-chain CDR3 are shown in SEQ ID NOs: 2016 and 2015, respectively.

For the IR-142 antibody of the present invention:

the amino acid sequence and the nucleotide sequence of the H-chain variable region (VH) are shown in SEQ ID NOs: 2794 and 2793, respectively;

the amino acid sequence and the nucleotide sequence of the L-chain variable region (VL) are shown in SEQ ID NOs: 2796 and 2795, respectively;

the amino acid sequence and the nucleotide sequence of the H-chain CDR1 are shown in SEQ ID NOs: 2022 and 2021, respectively;

the amino acid sequence and the nucleotide sequence of the H-chain CDR2 are shown in SEQ ID NOs: 2024 and 2023, respectively;

the amino acid sequence and the nucleotide sequence of the H-chain CDR3 are shown in SEQ ID NOs: 2026 and 2025, respectively;

the amino acid sequence and the nucleotide sequence of the L-chain CDR1 are shown in SEQ ID NOs: 2028 and 2027, respectively;

the amino acid sequence and the nucleotide sequence of the L-chain CDR2 are shown in SEQ ID NOs: 2030 and 2029, respectively;

the amino acid sequence and the nucleotide sequence of the L-chain CDR3 are shown in SEQ ID NOs: 2032 and 2031, respectively.

For the IR-143 antibody of the present invention:

the amino acid sequence and the nucleotide sequence of the H-chain variable region (VH) are shown in SEQ ID NOs: 2798 and 2797, respectively;

the amino acid sequence and the nucleotide sequence of the L-chain variable region (VL) are shown in SEQ ID NOs: 2800 and 2799, respectively;

the amino acid sequence and the nucleotide sequence of the H-chain CDR1 are shown in SEQ ID NOs: 2038 and 2037, respectively;

the amino acid sequence and the nucleotide sequence of the H-chain CDR2 are shown in SEQ ID NOs: 2040 and 2039, respectively;

the amino acid sequence and the nucleotide sequence of the H-chain CDR3 are shown in SEQ ID NOs: 2042 and 2041, respectively;

the amino acid sequence and the nucleotide sequence of the L-chain CDR1 are shown in SEQ ID NOs: 2044 and 2043, respectively;

the amino acid sequence and the nucleotide sequence of the L-chain CDR2 are shown in SEQ ID NOs: 2046 and 2045, respectively;

the amino acid sequence and the nucleotide sequence of the L-chain CDR3 are shown in SEQ ID NOs: 2048 and 2047, respectively.

For the IR-144 antibody of the present invention:

the amino acid sequence and the nucleotide sequence of the H-chain variable region (VH) are shown in SEQ ID NOs: 2802 and 2801, respectively;

the amino acid sequence and the nucleotide sequence of the L-chain variable region (VL) are shown in SEQ ID NOs: 2804 and 2803, respectively;

the amino acid sequence and the nucleotide sequence of the H-chain CDR1 are shown in SEQ ID NOs: 2054 and 2053, respectively;

the amino acid sequence and the nucleotide sequence of the H-chain CDR2 are shown in SEQ ID NOs: 2056 and 2055, respectively;

the amino acid sequence and the nucleotide sequence of the H-chain CDR3 are shown in SEQ ID NOs: 2058 and 2057, respectively;

the amino acid sequence and the nucleotide sequence of the L-chain CDR1 are shown in SEQ ID NOs: 2060 and 2059, respectively;

the amino acid sequence and the nucleotide sequence of the L-chain CDR2 are shown in SEQ ID NOs: 2062 and 2061, respectively;

the amino acid sequence and the nucleotide sequence of the L-chain CDR3 are shown in SEQ ID NOs: 2064 and 2063, respectively.

For the IR-145 antibody of the present invention:

the amino acid sequence and the nucleotide sequence of the H-chain variable region (VH) are shown in SEQ ID NOs: 2806 and 2805, respectively;

the amino acid sequence and the nucleotide sequence of the L-chain variable region (VL) are shown in SEQ ID NOs: 2808 and 2807, respectively;

the amino acid sequence and the nucleotide sequence of the H-chain CDR1 are shown in SEQ ID NOs: 2070 and 2069, respectively;

the amino acid sequence and the nucleotide sequence of the H-chain CDR2 are shown in SEQ ID NOs: 2072 and 2071, respectively;

the amino acid sequence and the nucleotide sequence of the H-chain CDR3 are shown in SEQ ID NOs: 2074 and 2073, respectively;

the amino acid sequence and the nucleotide sequence of the L-chain CDR1 are shown in SEQ ID NOs: 2076 and 2075, respectively;

the amino acid sequence and the nucleotide sequence of the L-chain CDR2 are shown in SEQ ID NOs: 2078 and 2077, respectively;

the amino acid sequence and the nucleotide sequence of the L-chain CDR3 are shown in SEQ ID NOs: 2080 and 2079, respectively.

For the IR-146 antibody of the present invention:

the amino acid sequence and the nucleotide sequence of the H-chain variable region (VH) are shown in SEQ ID NOs: 2810 and 2809, respectively;

the amino acid sequence and the nucleotide sequence of the L-chain variable region (VL) are shown in SEQ ID NOs: 2812 and 2811, respectively;

the amino acid sequence and the nucleotide sequence of the H-chain CDR1 are shown in SEQ ID NOs: 2086 and 2085, respectively;

the amino acid sequence and the nucleotide sequence of the H-chain CDR2 are shown in SEQ ID NOs: 2088 and 2087, respectively;

the amino acid sequence and the nucleotide sequence of the H-chain CDR3 are shown in SEQ ID NOs: 2090 and 2089, respectively;

the amino acid sequence and the nucleotide sequence of the L-chain CDR1 are shown in SEQ ID NOs: 2092 and 2091, respectively;

the amino acid sequence and the nucleotide sequence of the L-chain CDR2 are shown in SEQ ID NOs: 2094 and 2093, respectively;

the amino acid sequence and the nucleotide sequence of the L-chain CDR3 are shown in SEQ ID NOs: 2096 and 2095, respectively.

For the IR-147 antibody of the present invention:

the amino acid sequence and the nucleotide sequence of the H-chain variable region (VH) are shown in SEQ ID NOs: 2814 and 2813, respectively;

the amino acid sequence and the nucleotide sequence of the L-chain variable region (VL) are shown in SEQ ID NOs: 2816 and 2815, respectively;

the amino acid sequence and the nucleotide sequence of the H-chain CDR1 are shown in SEQ ID NOs: 2102 and 2101, respectively;

the amino acid sequence and the nucleotide sequence of the H-chain CDR2 are shown in SEQ ID NOs: 2104 and 2103, respectively;

the amino acid sequence and the nucleotide sequence of the H-chain CDR3 are shown in SEQ ID NOs: 2106 and 2105, respectively;

the amino acid sequence and the nucleotide sequence of the L-chain CDR1 are shown in SEQ ID NOs: 2108 and 2107, respectively;

the amino acid sequence and the nucleotide sequence of the L-chain CDR2 are shown in SEQ ID NOs: 2110 and 2109, respectively;

the amino acid sequence and the nucleotide sequence of the L-chain CDR3 are shown in SEQ ID NOs: 2112 and 2111, respectively.

For the IR-149 antibody of the present invention:

the amino acid sequence and the nucleotide sequence of the H-chain variable region (VH) are shown in SEQ ID NOs: 2818 and 2817, respectively;

the amino acid sequence and the nucleotide sequence of the L-chain variable region (VL) are shown in SEQ ID NOs: 2820 and 2819, respectively;

the amino acid sequence and the nucleotide sequence of the H-chain CDR1 are shown in SEQ ID NOs: 2118 and 2117, respectively;

the amino acid sequence and the nucleotide sequence of the H-chain CDR2 are shown in SEQ ID NOs: 2120 and 2119, respectively;

the amino acid sequence and the nucleotide sequence of the H-chain CDR3 are shown in SEQ ID NOs: 2122 and 2121, respectively;

the amino acid sequence and the nucleotide sequence of the L-chain CDR1 are shown in SEQ ID NOs: 2124 and 2123, respectively;

the amino acid sequence and the nucleotide sequence of the L-chain CDR2 are shown in SEQ ID NOs: 2126 and 2125, respectively;

the amino acid sequence and the nucleotide sequence of the L-chain CDR3 are shown in SEQ ID NOs: 2128 and 2127, respectively.

For the IR-150 antibody of the present invention:

the amino acid sequence and the nucleotide sequence of the H-chain variable region (VH) are shown in SEQ ID NOs: 2822 and 2821, respectively;

the amino acid sequence and the nucleotide sequence of the L-chain variable region (VL) are shown in SEQ ID NOs: 2824 and 2823, respectively;

the amino acid sequence and the nucleotide sequence of the H-chain CDR1 are shown in SEQ ID NOs: 2134 and 2133, respectively;

the amino acid sequence and the nucleotide sequence of the H-chain CDR2 are shown in SEQ ID NOs: 2136 and 2135, respectively;

the amino acid sequence and the nucleotide sequence of the H-chain CDR3 are shown in SEQ ID NOs: 2138 and 2137, respectively;

the amino acid sequence and the nucleotide sequence of the L-chain CDR1 are shown in SEQ ID NOs: 2140 and 2139, respectively;

the amino acid sequence and the nucleotide sequence of the L-chain CDR2 are shown in SEQ ID NOs: 2142 and 2141, respectively;

the amino acid sequence and the nucleotide sequence of the L-chain CDR3 are shown in SEQ ID NOs: 2144 and 2143, respectively.

For the IR-151 antibody of the present invention:

the amino acid sequence and the nucleotide sequence of the H-chain variable region (VH) are shown in SEQ ID NOs: 2826 and 2825, respectively;

the amino acid sequence and the nucleotide sequence of the L-chain variable region (VL) are shown in SEQ ID NOs: 2828 and 2827, respectively;

the amino acid sequence and the nucleotide sequence of the H-chain CDR1 are shown in SEQ ID NOs: 2150 and 2149, respectively;

the amino acid sequence and the nucleotide sequence of the H-chain CDR2 are shown in SEQ ID NOs: 2152 and 2151, respectively;

the amino acid sequence and the nucleotide sequence of the H-chain CDR3 are shown in SEQ ID NOs: 2154 and 2153, respectively;

the amino acid sequence and the nucleotide sequence of the L-chain CDR1 are shown in SEQ ID NOs: 2156 and 2155, respectively;

the amino acid sequence and the nucleotide sequence of the L-chain CDR2 are shown in SEQ ID NOs: 2158 and 2157, respectively;

the amino acid sequence and the nucleotide sequence of the L-chain CDR3 are shown in SEQ ID NOs: 2160 and 2159, respectively.

For the IR-152 antibody of the present invention:

the amino acid sequence and the nucleotide sequence of the H-chain variable region (VH) are shown in SEQ ID NOs: 2830 and 2829, respectively;

the amino acid sequence and the nucleotide sequence of the L-chain variable region (VL) are shown in SEQ ID NOs: 2832 and 2831, respectively;

the amino acid sequence and the nucleotide sequence of the H-chain CDR1 are shown in SEQ ID NOs: 2166 and 2165, respectively;

the amino acid sequence and the nucleotide sequence of the H-chain CDR2 are shown in SEQ ID NOs: 2168 and 2167, respectively;

the amino acid sequence and the nucleotide sequence of the H-chain CDR3 are shown in SEQ ID NOs: 2170 and 2169, respectively;

the amino acid sequence and the nucleotide sequence of the L-chain CDR1 are shown in SEQ ID NOs: 2172 and 2171, respectively;

the amino acid sequence and the nucleotide sequence of the L-chain CDR2 are shown in SEQ ID NOs: 2174 and 2173, respectively;

the amino acid sequence and the nucleotide sequence of the L-chain CDR3 are shown in SEQ ID NOs: 2176 and 2175, respectively.

For the IR-153 antibody of the present invention:

the amino acid sequence and the nucleotide sequence of the H-chain variable region (VH) are shown in SEQ ID NOs: 2834 and 2833, respectively;

the amino acid sequence and the nucleotide sequence of the L-chain variable region (VL) are shown in SEQ ID NOs: 2836 and 2835, respectively;

the amino acid sequence and the nucleotide sequence of the H-chain CDR1 are shown in SEQ ID NOs: 2182 and 2181, respectively;

the amino acid sequence and the nucleotide sequence of the H-chain CDR2 are shown in SEQ ID NOs: 2184 and 2183, respectively;

the amino acid sequence and the nucleotide sequence of the H-chain CDR3 are shown in SEQ ID NOs: 2186 and 2185, respectively;

the amino acid sequence and the nucleotide sequence of the L-chain CDR1 are shown in SEQ ID NOs: 2188 and 2187, respectively;

the amino acid sequence and the nucleotide sequence of the L-chain CDR2 are shown in SEQ ID NOs: 2190 and 2189, respectively;

the amino acid sequence and the nucleotide sequence of the L-chain CDR3 are shown in SEQ ID NOs: 2192 and 2191, respectively.

For the IR-154 antibody of the present invention:

the amino acid sequence and the nucleotide sequence of the H-chain variable region (VH) are shown in SEQ ID NOs: 2838 and 2837, respectively;

the amino acid sequence and the nucleotide sequence of the L-chain variable region (VL) are shown in SEQ ID NOs: 2840 and 2839, respectively;

the amino acid sequence and the nucleotide sequence of the H-chain CDR1 are shown in SEQ ID NOs: 2198 and 2197, respectively;

the amino acid sequence and the nucleotide sequence of the H-chain CDR2 are shown in SEQ ID NOs: 2200 and 2199, respectively;

the amino acid sequence and the nucleotide sequence of the H-chain CDR3 are shown in SEQ ID NOs: 2202 and 2201, respectively;

the amino acid sequence and the nucleotide sequence of the L-chain CDR1 are shown in SEQ ID NOs: 2204 and 2203, respectively;

the amino acid sequence and the nucleotide sequence of the L-chain CDR2 are shown in SEQ ID NOs: 2206 and 2205, respectively;

the amino acid sequence and the nucleotide sequence of the L-chain CDR3 are shown in SEQ ID NOs: 2208 and 2207, respectively.

For the IR-155 antibody of the present invention:
the amino acid sequence and the nucleotide sequence of the H-chain variable region (VH) are shown in SEQ ID NOs: 2842 and 2841, respectively;
the amino acid sequence and the nucleotide sequence of the L-chain variable region (VL) are shown in SEQ ID NOs: 2844 and 2843, respectively;
the amino acid sequence and the nucleotide sequence of the H-chain CDR1 are shown in SEQ ID NOs: 2214 and 2213, respectively;
the amino acid sequence and the nucleotide sequence of the H-chain CDR2 are shown in SEQ ID NOs: 2216 and 2215, respectively;
the amino acid sequence and the nucleotide sequence of the H-chain CDR3 are shown in SEQ ID NOs: 2218 and 2217, respectively;
the amino acid sequence and the nucleotide sequence of the L-chain CDR1 are shown in SEQ ID NOs: 2220 and 2219, respectively;
the amino acid sequence and the nucleotide sequence of the L-chain CDR2 are shown in SEQ ID NOs: 2222 and 2221, respectively;
the amino acid sequence and the nucleotide sequence of the L-chain CDR3 are shown in SEQ ID NOs: 2224 and 2223, respectively.

For the IR-156 antibody of the present invention:
the amino acid sequence and the nucleotide sequence of the H-chain variable region (VH) are shown in SEQ ID NOs: 2846 and 2845, respectively;
the amino acid sequence and the nucleotide sequence of the L-chain variable region (VL) are shown in SEQ ID NOs: 2848 and 2847, respectively;
the amino acid sequence and the nucleotide sequence of the H-chain CDR1 are shown in SEQ ID NOs: 2230 and 2229, respectively;
the amino acid sequence and the nucleotide sequence of the H-chain CDR2 are shown in SEQ ID NOs: 2232 and 2231, respectively;
the amino acid sequence and the nucleotide sequence of the H-chain CDR3 are shown in SEQ ID NOs: 2234 and 2233, respectively;
the amino acid sequence and the nucleotide sequence of the L-chain CDR1 are shown in SEQ ID NOs: 2236 and 2235, respectively;
the amino acid sequence and the nucleotide sequence of the L-chain CDR2 are shown in SEQ ID NOs: 2238 and 2237, respectively;
the amino acid sequence and the nucleotide sequence of the L-chain CDR3 are shown in SEQ ID NOs: 2240 and 2239, respectively.

For the IR-157 antibody of the present invention:
the amino acid sequence and the nucleotide sequence of the H-chain variable region (VH) are shown in SEQ ID NOs: 2850 and 2849, respectively;
the amino acid sequence and the nucleotide sequence of the L-chain variable region (VL) are shown in SEQ ID NOs: 2852 and 2851, respectively;
the amino acid sequence and the nucleotide sequence of the H-chain CDR1 are shown in SEQ ID NOs: 2246 and 2245, respectively;
the amino acid sequence and the nucleotide sequence of the H-chain CDR2 are shown in SEQ ID NOs: 2248 and 2247, respectively;
the amino acid sequence and the nucleotide sequence of the H-chain CDR3 are shown in SEQ ID NOs: 2250 and 2249, respectively;
the amino acid sequence and the nucleotide sequence of the L-chain CDR1 are shown in SEQ ID NOs: 2252 and 2251, respectively;
the amino acid sequence and the nucleotide sequence of the L-chain CDR2 are shown in SEQ ID NOs: 2254 and 2253, respectively;
the amino acid sequence and the nucleotide sequence of the L-chain CDR3 are shown in SEQ ID NOs: 2256 and 2255, respectively.

For the IR-158 antibody of the present invention:
the amino acid sequence and the nucleotide sequence of the H-chain variable region (VH) are shown in SEQ ID NOs: 2854 and 2853, respectively;
the amino acid sequence and the nucleotide sequence of the L-chain variable region (VL) are shown in SEQ ID NOs: 2856 and 2855, respectively;
the amino acid sequence and the nucleotide sequence of the H-chain CDR1 are shown in SEQ ID NOs: 2262 and 2261, respectively;
the amino acid sequence and the nucleotide sequence of the H-chain CDR2 are shown in SEQ ID NOs: 2264 and 2263, respectively;
the amino acid sequence and the nucleotide sequence of the H-chain CDR3 are shown in SEQ ID NOs: 2266 and 2265, respectively;
the amino acid sequence and the nucleotide sequence of the L-chain CDR1 are shown in SEQ ID NOs: 2268 and 2267, respectively;
the amino acid sequence and the nucleotide sequence of the L-chain CDR2 are shown in SEQ ID NOs: 2270 and 2269, respectively;
the amino acid sequence and the nucleotide sequence of the L-chain CDR3 are shown in SEQ ID NOs: 2272 and 2271, respectively.

For the IR-159 antibody of the present invention:
the amino acid sequence and the nucleotide sequence of the H-chain variable region (VH) are shown in SEQ ID NOs: 2858 and 2857, respectively;
the amino acid sequence and the nucleotide sequence of the L-chain variable region (VL) are shown in SEQ ID NOs: 2860 and 2859, respectively;
the amino acid sequence and the nucleotide sequence of the H-chain CDR1 are shown in SEQ ID NOs: 2278 and 2277, respectively;
the amino acid sequence and the nucleotide sequence of the H-chain CDR2 are shown in SEQ ID NOs: 2280 and 2279, respectively;
the amino acid sequence and the nucleotide sequence of the H-chain CDR3 are shown in SEQ ID NOs: 2282 and 2281, respectively;
the amino acid sequence and the nucleotide sequence of the L-chain CDR1 are shown in SEQ ID NOs: 2284 and 2283, respectively;
the amino acid sequence and the nucleotide sequence of the L-chain CDR2 are shown in SEQ ID NOs: 2286 and 2285, respectively;
the amino acid sequence and the nucleotide sequence of the L-chain CDR3 are shown in SEQ ID NOs: 2288 and 2287, respectively.

For the IR-160 antibody of the present invention:
the amino acid sequence and the nucleotide sequence of the H-chain variable region (VH) are shown in SEQ ID NOs: 2862 and 2861, respectively;

the amino acid sequence and the nucleotide sequence of the L-chain variable region (VL) are shown in SEQ ID NOs: 2864 and 2863, respectively;

the amino acid sequence and the nucleotide sequence of the H-chain CDR1 are shown in SEQ ID NOs: 2866 and 2865, respectively;

the amino acid sequence and the nucleotide sequence of the H-chain CDR2 are shown in SEQ ID NOs: 2868 and 2867, respectively;

the amino acid sequence and the nucleotide sequence of the H-chain CDR3 are shown in SEQ ID NOs: 2870 and 2869, respectively;

the amino acid sequence and the nucleotide sequence of the L-chain CDR1 are shown in SEQ ID NOs: 2872 and 2871, respectively;

the amino acid sequence and the nucleotide sequence of the L-chain CDR2 are shown in SEQ ID NOs: 2874 and 2873, respectively;

the amino acid sequence and the nucleotide sequence of the L-chain CDR3 are shown in SEQ ID NOs: 2876 and 2875, respectively.

For the IR-161 antibody of the present invention:

the amino acid sequence and the nucleotide sequence of the H-chain variable region (VH) are shown in SEQ ID NOs: 2878 and 2877, respectively;

the amino acid sequence and the nucleotide sequence of the L-chain variable region (VL) are shown in SEQ ID NOs: 2880 and 2879, respectively;

the amino acid sequence and the nucleotide sequence of the H-chain CDR1 are shown in SEQ ID NOs: 2882 and 2881, respectively;

the amino acid sequence and the nucleotide sequence of the H-chain CDR2 are shown in SEQ ID NOs: 2884 and 2883, respectively;

the amino acid sequence and the nucleotide sequence of the H-chain CDR3 are shown in SEQ ID NOs: 2886 and 2885, respectively;

the amino acid sequence and the nucleotide sequence of the L-chain CDR1 are shown in SEQ ID NOs: 2888 and 2887, respectively;

the amino acid sequence and the nucleotide sequence of the L-chain CDR2 are shown in SEQ ID NOs: 2890 and 2889, respectively;

the amino acid sequence and the nucleotide sequence of the L-chain CDR3 are shown in SEQ ID NOs: 2892 and 2891, respectively.

In an embodiment, the antibodies of the present invention include minibodies. A minibody contains an antibody fragment lacking a portion of a whole antibody, and is not particularly limited as long as it has the ability to bind to an antigen. Examples of antibody fragments include Fab, Fab', F(ab')2, and Fv. Examples of minibodies include Fab, Fab', F(ab')2, Fv, scFv (single chain Fv), diabody, and sc(Fv)2 (single chain (Fv)2).

These minibodies can be obtained, for example, by treating an antibody with an enzyme to produce an antibody fragment. Known enzymes for producing an antibody fragment include papain, pepsin, and plasmin. Alternatively, a gene construct encoding an antibody fragment can be produced, inserted into an expression vector, and expressed in a suitable host cell (see, for example, Co, M. S. et al., J. Immunol. (1994) 152, 2968-2976, Better, M. and Horwitz, A. H. Methods in Enzymology (1989) 178, 476-496, Plueckthun, A. and Skerra, A. Methods in Enzymology (1989) 178, 476-496, Lamoyi, E., Methods in Enzymology (1989) 121, 652-663, Rousseaux, J. et al., Methods in Enzymology (1989) 121, 663-669, Bird, R. E. et al., TIBTECH (1991) 9, 132-137).

Herein, "antigen-binding fragments" means the above-mentioned antibody fragments having antigen-binding ability, or minibodies including the antibody fragments having antigen-binding ability. Antibody fragments that bind to A beta oligomers but not to A beta monomers, or antibody fragments that bind to A beta oligomers but not to A beta monomers and amyloid precursor protein, are also included in the present invention. Hereinafter, reference to "antibody" includes reference to the above "antigen-binding fragment".

Polyclonal antibodies of the present invention can be obtained by the following methods. To obtain the polyclonal antibodies, blood is removed from a mammal sensitized with an antigen after the mammal is immunized with an A beta oligomer (e.g., A beta tetramer) as a sensitizing antigen using a conventional method and the serum level of the desired antibody is confirmed to be increased. Serum is separated from blood by a known method. When a polyclonal antibody is used, serum containing the polyclonal antibody may be utilized. Alternatively, if necessary, a fraction containing the polyclonal antibody may be isolated from serum and then used. For example, immunoglobulin G or M can be prepared by obtaining a fraction that specifically recognizes an A beta oligomer using an affinity column coupled with an A beta oligomer, and then purifying this fraction using a Protein A or Protein G column.

The present invention provides A beta oligomers bound by the antibodies of the present invention. Preferably, the antibodies include the following:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies.

The A beta oligomers can be used as antigens for preparing antibodies, or vaccines.

In other words, in the present invention, the A beta oligomers are antigens bound by the following antibodies:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody.

Furthermore, the antibodies of the present invention include antibodies that bind to the antigens bound by the following antibodies:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody.

Furthermore, the present invention provides an antibody of any one of (1) to (290) below:

(1) an antibody that comprises an H chain having CDR1, CDR2, and CDR3, which are identified in VH comprising the amino acid sequence of SEQ ID NO: 2290;

(2) an antibody that comprises an L chain having CDR1, CDR2, and CDR3, which are identified in VL comprising the amino acid sequence of SEQ ID NO: 2292;

(3) an antibody that comprises an H chain having CDR1, CDR2, and CDR3, which are identified in VH comprising the amino acid sequence of SEQ ID NO: 2294;

(4) an antibody that comprises an L chain having CDR1, CDR2, and CDR3, which are identified in VL comprising the amino acid sequence of SEQ ID NO: 2296;

(5) an antibody that comprises an H chain having CDR1, CDR2, and CDR3, which are identified in VH comprising the amino acid sequence of SEQ ID NO: 2298;

(6) an antibody that comprises an L chain having CDR1, CDR2, and CDR3, which are identified in VL comprising the amino acid sequence of SEQ ID NO: 2300;

(7) an antibody that comprises an H chain having CDR1, CDR2, and CDR3, which are identified in VH comprising the amino acid sequence of SEQ ID NO: 2302;

(8) an antibody that comprises an L chain having CDR1, CDR2, and CDR3, which are identified in VL comprising the amino acid sequence of SEQ ID NO: 2304;

(9) an antibody that comprises an H chain having CDR1, CDR2, and CDR3, which are identified in VH comprising the amino acid sequence of SEQ ID NO: 2306;

(10) an antibody that comprises an L chain having CDR1, CDR2, and CDR3, which are identified in VL comprising the amino acid sequence of SEQ ID NO: 2308;

(11) an antibody that comprises an H chain having CDR1, CDR2, and CDR3, which are identified in VH comprising the amino acid sequence of SEQ ID NO: 2310;

(12) an antibody that comprises an L chain having CDR1, CDR2, and CDR3, which are identified in VL comprising the amino acid sequence of SEQ ID NO: 2312;

(13) an antibody that comprises an H chain having CDR1, CDR2, and CDR3, which are identified in VH comprising the amino acid sequence of SEQ ID NO: 2314;

(14) an antibody that comprises an L chain having CDR1, CDR2, and CDR3, which are identified in VL comprising the amino acid sequence of SEQ ID NO: 2316;

(15) an antibody that comprises an H chain having CDR1, CDR2, and CDR3, which are identified in VH comprising the amino acid sequence of SEQ ID NO: 2318;

(16) an antibody that comprises an L chain having CDR1, CDR2, and CDR3, which are identified in VL comprising the amino acid sequence of SEQ ID NO: 2320;

(17) an antibody that comprises an H chain having CDR1, CDR2, and CDR3, which are identified in VH comprising the amino acid sequence of SEQ ID NO: 2322;

(18) an antibody that comprises an L chain having CDR1, CDR2, and CDR3, which are identified in VL comprising the amino acid sequence of SEQ ID NO: 2324;

(19) an antibody that comprises an H chain having CDR1, CDR2, and CDR3, which are identified in VH comprising the amino acid sequence of SEQ ID NO: 2326;

(20) an antibody that comprises an L chain having CDR1, CDR2, and CDR3, which are identified in VL comprising the amino acid sequence of SEQ ID NO: 2328;

(21) an antibody that comprises an H chain having CDR1, CDR2, and CDR3, which are identified in VH comprising the amino acid sequence of SEQ ID NO: 2330;

(22) an antibody that comprises an L chain having CDR1, CDR2, and CDR3, which are identified in VL comprising the amino acid sequence of SEQ ID NO: 2332;

(23) an antibody that comprises an H chain having CDR1, CDR2, and CDR3, which are identified in VH comprising the amino acid sequence of SEQ ID NO: 2334;

(24) an antibody that comprises an L chain having CDR1, CDR2, and CDR3, which are identified in VL comprising the amino acid sequence of SEQ ID NO: 2336;

(25) an antibody that comprises an H chain having CDR1, CDR2, and CDR3, which are identified in VH comprising the amino acid sequence of SEQ ID NO: 2338;

(26) an antibody that comprises an L chain having CDR1, CDR2, and CDR3, which are identified in VL comprising the amino acid sequence of SEQ ID NO: 2340;

(27) an antibody that comprises an H chain having CDR1, CDR2, and CDR3, which are identified in VH comprising the amino acid sequence of SEQ ID NO: 2342;

(28) an antibody that comprises an L chain having CDR1, CDR2, and CDR3, which are identified in VL comprising the amino acid sequence of SEQ ID NO: 2344;

(29) an antibody that comprises an H chain having CDR1, CDR2, and CDR3, which are identified in VH comprising the amino acid sequence of SEQ ID NO: 2346;

(30) an antibody that comprises an L chain having CDR1, CDR2, and CDR3, which are identified in VL comprising the amino acid sequence of SEQ ID NO: 2348;

(31) an antibody that comprises an H chain having CDR1, CDR2, and CDR3, which are identified in VH comprising the amino acid sequence of SEQ ID NO: 2350;

(32) an antibody that comprises an L chain having CDR1, CDR2, and CDR3, which are identified in VL comprising the amino acid sequence of SEQ ID NO: 2352;

(33) an antibody that comprises an H chain having CDR1, CDR2, and CDR3, which are identified in VH comprising the amino acid sequence of SEQ ID NO: 2354;

(34) an antibody that comprises an L chain having CDR1, CDR2, and CDR3, which are identified in VL comprising the amino acid sequence of SEQ ID NO: 2356;

(35) an antibody that comprises an H chain having CDR1, CDR2, and CDR3, which are identified in VH comprising the amino acid sequence of SEQ ID NO: 2358;

(36) an antibody that comprises an L chain having CDR1, CDR2, and CDR3, which are identified in VL comprising the amino acid sequence of SEQ ID NO: 2360;

(37) an antibody that comprises an H chain having CDR1, CDR2, and CDR3, which are identified in VH comprising the amino acid sequence of SEQ ID NO: 2362;

(38) an antibody that comprises an L chain having CDR1, CDR2, and CDR3, which are identified in VL comprising the amino acid sequence of SEQ ID NO: 2364;

(39) an antibody that comprises an H chain having CDR1, CDR2, and CDR3, which are identified in VH comprising the amino acid sequence of SEQ ID NO: 2366;

(40) an antibody that comprises an L chain having CDR1, CDR2, and CDR3, which are identified in VL comprising the amino acid sequence of SEQ ID NO: 2368;

(41) an antibody that comprises an H chain having CDR1, CDR2, and CDR3, which are identified in VH comprising the amino acid sequence of SEQ ID NO: 2370;

(42) an antibody that comprises an L chain having CDR1, CDR2, and CDR3, which are identified in VL comprising the amino acid sequence of SEQ ID NO: 2372;

(43) an antibody that comprises an H chain having CDR1, CDR2, and CDR3, which are identified in VH comprising the amino acid sequence of SEQ ID NO: 2374;

(44) an antibody that comprises an L chain having CDR1, CDR2, and CDR3, which are identified in VL comprising the amino acid sequence of SEQ ID NO: 2376;

(45) an antibody that comprises an H chain having CDR1, CDR2, and CDR3, which are identified in VH comprising the amino acid sequence of SEQ ID NO: 2378;

(46) an antibody that comprises an L chain having CDR1, CDR2, and CDR3, which are identified in VL comprising the amino acid sequence of SEQ ID NO: 2380;

(47) an antibody that comprises an H chain having CDR1, CDR2, and CDR3, which are identified in VH comprising the amino acid sequence of SEQ ID NO: 2382;

(48) an antibody that comprises an L chain having CDR1, CDR2, and CDR3, which are identified in VL comprising the amino acid sequence of SEQ ID NO: 2384;

(49) an antibody that comprises an H chain having CDR1, CDR2, and CDR3, which are identified in VH comprising the amino acid sequence of SEQ ID NO: 2386;

(50) an antibody that comprises an L chain having CDR1, CDR2, and CDR3, which are identified in VL comprising the amino acid sequence of SEQ ID NO: 2388;

(51) an antibody that comprises an H chain having CDR1, CDR2, and CDR3, which are identified in VH comprising the amino acid sequence of SEQ ID NO: 2390;

(52) an antibody that comprises an L chain having CDR1, CDR2, and CDR3, which are identified in VL comprising the amino acid sequence of SEQ ID NO: 2392;

(53) an antibody that comprises an H chain having CDR1, CDR2, and CDR3, which are identified in VH comprising the amino acid sequence of SEQ ID NO: 2394;

(54) an antibody that comprises an L chain having CDR1, CDR2, and CDR3, which are identified in VL comprising the amino acid sequence of SEQ ID NO: 2396;

(55) an antibody that comprises an H chain having CDR1, CDR2, and CDR3, which are identified in VH comprising the amino acid sequence of SEQ ID NO: 2398;

(56) an antibody that comprises an L chain having CDR1, CDR2, and CDR3, which are identified in VL comprising the amino acid sequence of SEQ ID NO: 2400;

(57) an antibody that comprises an H chain having CDR1, CDR2, and CDR3, which are identified in VH comprising the amino acid sequence of SEQ ID NO: 2402;

(58) an antibody that comprises an L chain having CDR1, CDR2, and CDR3, which are identified in VL comprising the amino acid sequence of SEQ ID NO: 2404;

(59) an antibody that comprises an H chain having CDR1, CDR2, and CDR3, which are identified in VH comprising the amino acid sequence of SEQ ID NO: 2406;

(60) an antibody that comprises an L chain having CDR1, CDR2, and CDR3, which are identified in VL comprising the amino acid sequence of SEQ ID NO: 2408;

(61) an antibody that comprises an H chain having CDR1, CDR2, and CDR3, which are identified in VH comprising the amino acid sequence of SEQ ID NO: 2410;

(62) an antibody that comprises an L chain having CDR1, CDR2, and CDR3, which are identified in VL comprising the amino acid sequence of SEQ ID NO: 2412;

(63) an antibody that comprises an H chain having CDR1, CDR2, and CDR3, which are identified in VH comprising the amino acid sequence of SEQ ID NO: 2414;

(64) an antibody that comprises an L chain having CDR1, CDR2, and CDR3, which are identified in VL comprising the amino acid sequence of SEQ ID NO: 2416;

(65) an antibody that comprises an H chain having CDR1, CDR2, and CDR3, which are identified in VH comprising the amino acid sequence of SEQ ID NO: 2418;

(66) an antibody that comprises an L chain having CDR1, CDR2, and CDR3, which are identified in VL comprising the amino acid sequence of SEQ ID NO: 2420;

(67) an antibody that comprises an H chain having CDR1, CDR2, and CDR3, which are identified in VH comprising the amino acid sequence of SEQ ID NO: 2422;

(68) an antibody that comprises an L chain having CDR1, CDR2, and CDR3, which are identified in VL comprising the amino acid sequence of SEQ ID NO: 2424;

(69) an antibody that comprises an H chain having CDR1, CDR2, and CDR3, which are identified in VH comprising the amino acid sequence of SEQ ID NO: 2426;

(70) an antibody that comprises an L chain having CDR1, CDR2, and CDR3, which are identified in VL comprising the amino acid sequence of SEQ ID NO: 2428;

(71) an antibody that comprises an H chain having CDR1, CDR2, and CDR3, which are identified in VH comprising the amino acid sequence of SEQ ID NO: 2430;

(72) an antibody that comprises an L chain having CDR1, CDR2, and CDR3, which are identified in VL comprising the amino acid sequence of SEQ ID NO: 2432;

(73) an antibody that comprises an H chain having CDR1, CDR2, and CDR3, which are identified in VH comprising the amino acid sequence of SEQ ID NO: 2434;

(74) an antibody that comprises an L chain having CDR1, CDR2, and CDR3, which are identified in VL comprising the amino acid sequence of SEQ ID NO: 2436;

(75) an antibody that comprises an H chain having CDR1, CDR2, and CDR3, which are identified in VH comprising the amino acid sequence of SEQ ID NO: 2438;

(76) an antibody that comprises an L chain having CDR1, CDR2, and CDR3, which are identified in VL comprising the amino acid sequence of SEQ ID NO: 2440;

(77) an antibody that comprises an H chain having CDR1, CDR2, and CDR3, which are identified in VH comprising the amino acid sequence of SEQ ID NO: 2442;

(78) an antibody that comprises an L chain having CDR1, CDR2, and CDR3, which are identified in VL comprising the amino acid sequence of SEQ ID NO: 2444;
(79) an antibody that comprises an H chain having CDR1, CDR2, and CDR3, which are identified in VH comprising the amino acid sequence of SEQ ID NO: 2446;
(80) an antibody that comprises an L chain having CDR1, CDR2, and CDR3, which are identified in VL comprising the amino acid sequence of SEQ ID NO: 2448;
(81) an antibody that comprises an H chain having CDR1, CDR2, and CDR3, which are identified in VH comprising the amino acid sequence of SEQ ID NO: 2450;
(82) an antibody that comprises an L chain having CDR1, CDR2, and CDR3, which are identified in VL comprising the amino acid sequence of SEQ ID NO: 2452;
(83) an antibody that comprises an H chain having CDR1, CDR2, and CDR3, which are identified in VH comprising the amino acid sequence of SEQ ID NO: 2454;
(84) an antibody that comprises an L chain having CDR1, CDR2, and CDR3, which are identified in VL comprising the amino acid sequence of SEQ ID NO: 2456;
(85) an antibody that comprises an H chain having CDR1, CDR2, and CDR3, which are identified in VH comprising the amino acid sequence of SEQ ID NO: 2458;
(86) an antibody that comprises an L chain having CDR1, CDR2, and CDR3, which are identified in VL comprising the amino acid sequence of SEQ ID NO: 2460;
(87) an antibody that comprises an H chain having CDR1, CDR2, and CDR3, which are identified in VH comprising the amino acid sequence of SEQ ID NO: 2462;
(88) an antibody that comprises an L chain having CDR1, CDR2, and CDR3, which are identified in VL comprising the amino acid sequence of SEQ ID NO: 2464;
(89) an antibody that comprises an H chain having CDR1, CDR2, and CDR3, which are identified in VH comprising the amino acid sequence of SEQ ID NO: 2466;
(90) an antibody that comprises an L chain having CDR1, CDR2, and CDR3, which are identified in VL comprising the amino acid sequence of SEQ ID NO: 2468;
(91) an antibody that comprises an H chain having CDR1, CDR2, and CDR3, which are identified in VH comprising the amino acid sequence of SEQ ID NO: 2470;
(92) an antibody that comprises an L chain having CDR1, CDR2, and CDR3, which are identified in VL comprising the amino acid sequence of SEQ ID NO: 2472;
(93) an antibody that comprises an H chain having CDR1, CDR2, and CDR3, which are identified in VH comprising the amino acid sequence of SEQ ID NO: 2474;
(94) an antibody that comprises an L chain having CDR1, CDR2, and CDR3, which are identified in VL comprising the amino acid sequence of SEQ ID NO: 2476;
(95) an antibody that comprises an H chain having CDR1, CDR2, and CDR3, which are identified in VH comprising the amino acid sequence of SEQ ID NO: 2478;
(96) an antibody that comprises an L chain having CDR1, CDR2, and CDR3, which are identified in VL comprising the amino acid sequence of SEQ ID NO: 2480;
(97) an antibody that comprises an H chain having CDR1, CDR2, and CDR3, which are identified in VH comprising the amino acid sequence of SEQ ID NO: 2482;
(98) an antibody that comprises an L chain having CDR1, CDR2, and CDR3, which are identified in VL comprising the amino acid sequence of SEQ ID NO: 2484;
(99) an antibody that comprises an H chain having CDR1, CDR2, and CDR3, which are identified in VH comprising the amino acid sequence of SEQ ID NO: 2486;
(100) an antibody that comprises an L chain having CDR1, CDR2, and CDR3, which are identified in VL comprising the amino acid sequence of SEQ ID NO: 2488;
(101) an antibody that comprises an H chain having CDR1, CDR2, and CDR3, which are identified in VH comprising the amino acid sequence of SEQ ID NO: 2490;
(102) an antibody that comprises an L chain having CDR1, CDR2, and CDR3, which are identified in VL comprising the amino acid sequence of SEQ ID NO: 2492;
(103) an antibody that comprises an H chain having CDR1, CDR2, and CDR3, which are identified in VH comprising the amino acid sequence of SEQ ID NO: 2494;
(104) an antibody that comprises an L chain having CDR1, CDR2, and CDR3, which are identified in VL comprising the amino acid sequence of SEQ ID NO: 2496;
(105) an antibody that comprises an H chain having CDR1, CDR2, and CDR3, which are identified in VH comprising the amino acid sequence of SEQ ID NO: 2498;
(106) an antibody that comprises an L chain having CDR1, CDR2, and CDR3, which are identified in VL comprising the amino acid sequence of SEQ ID NO: 2500;
(107) an antibody that comprises an H chain having CDR1, CDR2, and CDR3, which are identified in VH comprising the amino acid sequence of SEQ ID NO: 2502;
(108) an antibody that comprises an L chain having CDR1, CDR2, and CDR3, which are identified in VL comprising the amino acid sequence of SEQ ID NO: 2504;
(109) an antibody that comprises an H chain having CDR1, CDR2, and CDR3, which are identified in VH comprising the amino acid sequence of SEQ ID NO: 2506;
(110) an antibody that comprises an L chain having CDR1, CDR2, and CDR3, which are identified in VL comprising the amino acid sequence of SEQ ID NO: 2508;
(111) an antibody that comprises an H chain having CDR1, CDR2, and CDR3, which are identified in VH comprising the amino acid sequence of SEQ ID NO: 2510;
(112) an antibody that comprises an L chain having CDR1, CDR2, and CDR3, which are identified in VL comprising the amino acid sequence of SEQ ID NO: 2512;
(113) an antibody that comprises an H chain having CDR1, CDR2, and CDR3, which are identified in VH comprising the amino acid sequence of SEQ ID NO: 2514;
(114) an antibody that comprises an L chain having CDR1, CDR2, and CDR3, which are identified in VL comprising the amino acid sequence of SEQ ID NO: 2516;
(115) an antibody that comprises an H chain having CDR1, CDR2, and CDR3, which are identified in VH comprising the amino acid sequence of SEQ ID NO: 2518;
(116) an antibody that comprises an L chain having CDR1, CDR2, and CDR3, which are identified in VL comprising the amino acid sequence of SEQ ID NO: 2520;
(117) an antibody that comprises an H chain having CDR1, CDR2, and CDR3, which are identified in VH comprising the amino acid sequence of SEQ ID NO: 2522;
(118) an antibody that comprises an L chain having CDR1, CDR2, and CDR3, which are identified in VL comprising the amino acid sequence of SEQ ID NO: 2524;
(119) an antibody that comprises an H chain having CDR1, CDR2, and CDR3, which are identified in VH comprising the amino acid sequence of SEQ ID NO: 2526;
(120) an antibody that comprises an L chain having CDR1, CDR2, and CDR3, which are identified in VL comprising the amino acid sequence of SEQ ID NO: 2528;
(121) an antibody that comprises an H chain having CDR1, CDR2, and CDR3, which are identified in VH comprising the amino acid sequence of SEQ ID NO: 2530;

(122) an antibody that comprises an L chain having CDR1, CDR2, and CDR3, which are identified in VL comprising the amino acid sequence of SEQ ID NO: 2532;

(123) an antibody that comprises an H chain having CDR1, CDR2, and CDR3, which are identified in VH comprising the amino acid sequence of SEQ ID NO: 2534;

(124) an antibody that comprises an L chain having CDR1, CDR2, and CDR3, which are identified in VL comprising the amino acid sequence of SEQ ID NO: 2536;

(125) an antibody that comprises an H chain having CDR1, CDR2, and CDR3, which are identified in VH comprising the amino acid sequence of SEQ ID NO: 2538;

(126) an antibody that comprises an L chain having CDR1, CDR2, and CDR3, which are identified in VL comprising the amino acid sequence of SEQ ID NO: 2540;

(127) an antibody that comprises an H chain having CDR1, CDR2, and CDR3, which are identified in VH comprising the amino acid sequence of SEQ ID NO: 2542;

(128) an antibody that comprises an L chain having CDR1, CDR2, and CDR3, which are identified in VL comprising the amino acid sequence of SEQ ID NO: 2544;

(129) an antibody that comprises an H chain having CDR1, CDR2, and CDR3, which are identified in VH comprising the amino acid sequence of SEQ ID NO: 2546;

(130) an antibody that comprises an L chain having CDR1, CDR2, and CDR3, which are identified in VL comprising the amino acid sequence of SEQ ID NO: 2548;

(131) an antibody that comprises an H chain having CDR1, CDR2, and CDR3, which are identified in VH comprising the amino acid sequence of SEQ ID NO: 2550;

(132) an antibody that comprises an L chain having CDR1, CDR2, and CDR3, which are identified in VL comprising the amino acid sequence of SEQ ID NO: 2552;

(133) an antibody that comprises an H chain having CDR1, CDR2, and CDR3, which are identified in VH comprising the amino acid sequence of SEQ ID NO: 2554;

(134) an antibody that comprises an L chain having CDR1, CDR2, and CDR3, which are identified in VL comprising the amino acid sequence of SEQ ID NO: 2556;

(135) an antibody that comprises an H chain having CDR1, CDR2, and CDR3, which are identified in VH comprising the amino acid sequence of SEQ ID NO: 2558;

(136) an antibody that comprises an L chain having CDR1, CDR2, and CDR3, which are identified in VL comprising the amino acid sequence of SEQ ID NO: 2560;

(137) an antibody that comprises an H chain having CDR1, CDR2, and CDR3, which are identified in VH comprising the amino acid sequence of SEQ ID NO: 2562;

(138) an antibody that comprises an L chain having CDR1, CDR2, and CDR3, which are identified in VL comprising the amino acid sequence of SEQ ID NO: 2564;

(139) an antibody that comprises an H chain having CDR1, CDR2, and CDR3, which are identified in VH comprising the amino acid sequence of SEQ ID NO: 2566;

(140) an antibody that comprises an L chain having CDR1, CDR2, and CDR3, which are identified in VL comprising the amino acid sequence of SEQ ID NO: 2568;

(141) an antibody that comprises an H chain having CDR1, CDR2, and CDR3, which are identified in VH comprising the amino acid sequence of SEQ ID NO: 2570;

(142) an antibody that comprises an L chain having CDR1, CDR2, and CDR3, which are identified in VL comprising the amino acid sequence of SEQ ID NO: 2572;

(143) an antibody that comprises an H chain having CDR1, CDR2, and CDR3, which are identified in VH comprising the amino acid sequence of SEQ ID NO: 2574;

(144) an antibody that comprises an L chain having CDR1, CDR2, and CDR3, which are identified in VL comprising the amino acid sequence of SEQ ID NO: 2576;

(145) an antibody that comprises an H chain having CDR1, CDR2, and CDR3, which are identified in VH comprising the amino acid sequence of SEQ ID NO: 2578;

(146) an antibody that comprises an L chain having CDR1, CDR2, and CDR3, which are identified in VL comprising the amino acid sequence of SEQ ID NO: 2580;

(147) an antibody that comprises an H chain having CDR1, CDR2, and CDR3, which are identified in VH comprising the amino acid sequence of SEQ ID NO: 2582;

(148) an antibody that comprises an L chain having CDR1, CDR2, and CDR3, which are identified in VL comprising the amino acid sequence of SEQ ID NO: 2584;

(149) an antibody that comprises an H chain having CDR1, CDR2, and CDR3, which are identified in VH comprising the amino acid sequence of SEQ ID NO: 2586;

(150) an antibody that comprises an L chain having CDR1, CDR2, and CDR3, which are identified in VL comprising the amino acid sequence of SEQ ID NO: 2588;

(151) an antibody that comprises an H chain having CDR1, CDR2, and CDR3, which are identified in VH comprising the amino acid sequence of SEQ ID NO: 2590;

(152) an antibody that comprises an L chain having CDR1, CDR2, and CDR3, which are identified in VL comprising the amino acid sequence of SEQ ID NO: 2592;

(153) an antibody that comprises an H chain having CDR1, CDR2, and CDR3, which are identified in VH comprising the amino acid sequence of SEQ ID NO: 2594;

(154) an antibody that comprises an L chain having CDR1, CDR2, and CDR3, which are identified in VL comprising the amino acid sequence of SEQ ID NO: 2596;

(155) an antibody that comprises an H chain having CDR1, CDR2, and CDR3, which are identified in VH comprising the amino acid sequence of SEQ ID NO: 2598;

(156) an antibody that comprises an L chain having CDR1, CDR2, and CDR3, which are identified in VL comprising the amino acid sequence of SEQ ID NO: 2600;

(157) an antibody that comprises an H chain having CDR1, CDR2, and CDR3, which are identified in VH comprising the amino acid sequence of SEQ ID NO: 2602;

(158) an antibody that comprises an L chain having CDR1, CDR2, and CDR3, which are identified in VL comprising the amino acid sequence of SEQ ID NO: 2604;

(159) an antibody that comprises an H chain having CDR1, CDR2, and CDR3, which are identified in VH comprising the amino acid sequence of SEQ ID NO: 2606;

(160) an antibody that comprises an L chain having CDR1, CDR2, and CDR3, which are identified in VL comprising the amino acid sequence of SEQ ID NO: 2608;

(161) an antibody that comprises an H chain having CDR1, CDR2, and CDR3, which are identified in VH comprising the amino acid sequence of SEQ ID NO: 2610;

(162) an antibody that comprises an L chain having CDR1, CDR2, and CDR3, which are identified in VL comprising the amino acid sequence of SEQ ID NO: 2612;

(163) an antibody that comprises an H chain having CDR1, CDR2, and CDR3, which are identified in VH comprising the amino acid sequence of SEQ ID NO: 2614;

(164) an antibody that comprises an L chain having CDR1, CDR2, and CDR3, which are identified in VL comprising the amino acid sequence of SEQ ID NO: 2616;

(165) an antibody that comprises an H chain having CDR1, CDR2, and CDR3, which are identified in VH comprising the amino acid sequence of SEQ ID NO: 2618;

(166) an antibody that comprises an L chain having CDR1, CDR2, and CDR3, which are identified in VL comprising the amino acid sequence of SEQ ID NO: 2620;

(167) an antibody that comprises an H chain having CDR1, CDR2, and CDR3, which are identified in VH comprising the amino acid sequence of SEQ ID NO: 2622;

(168) an antibody that comprises an L chain having CDR1, CDR2, and CDR3, which are identified in VL comprising the amino acid sequence of SEQ ID NO: 2624;

(169) an antibody that comprises an H chain having CDR1, CDR2, and CDR3, which are identified in VH comprising the amino acid sequence of SEQ ID NO: 2626;

(170) an antibody that comprises an L chain having CDR1, CDR2, and CDR3, which are identified in VL comprising the amino acid sequence of SEQ ID NO: 2628;

(171) an antibody that comprises an H chain having CDR1, CDR2, and CDR3, which are identified in VH comprising the amino acid sequence of SEQ ID NO: 2630;

(172) an antibody that comprises an L chain having CDR1, CDR2, and CDR3, which are identified in VL comprising the amino acid sequence of SEQ ID NO: 2632;

(173) an antibody that comprises an H chain having CDR1, CDR2, and CDR3, which are identified in VH comprising the amino acid sequence of SEQ ID NO: 2634;

(174) an antibody that comprises an L chain having CDR1, CDR2, and CDR3, which are identified in VL comprising the amino acid sequence of SEQ ID NO: 2636;

(175) an antibody that comprises an H chain having CDR1, CDR2, and CDR3, which are identified in VH comprising the amino acid sequence of SEQ ID NO: 2638;

(176) an antibody that comprises an L chain having CDR1, CDR2, and CDR3, which are identified in VL comprising the amino acid sequence of SEQ ID NO: 2640;

(177) an antibody that comprises an H chain having CDR1, CDR2, and CDR3, which are identified in VH comprising the amino acid sequence of SEQ ID NO: 2642;

(178) an antibody that comprises an L chain having CDR1, CDR2, and CDR3, which are identified in VL comprising the amino acid sequence of SEQ ID NO: 2644;

(179) an antibody that comprises an H chain having CDR1, CDR2, and CDR3, which are identified in VH comprising the amino acid sequence of SEQ ID NO: 2646;

(180) an antibody that comprises an L chain having CDR1, CDR2, and CDR3, which are identified in VL comprising the amino acid sequence of SEQ ID NO: 2648;

(181) an antibody that comprises an H chain having CDR1, CDR2, and CDR3, which are identified in VH comprising the amino acid sequence of SEQ ID NO: 2650;

(182) an antibody that comprises an L chain having CDR1, CDR2, and CDR3, which are identified in VL comprising the amino acid sequence of SEQ ID NO: 2652;

(183) an antibody that comprises an H chain having CDR1, CDR2, and CDR3, which are identified in VH comprising the amino acid sequence of SEQ ID NO: 2654;

(184) an antibody that comprises an L chain having CDR1, CDR2, and CDR3, which are identified in VL comprising the amino acid sequence of SEQ ID NO: 2656;

(185) an antibody that comprises an H chain having CDR1, CDR2, and CDR3, which are identified in VH comprising the amino acid sequence of SEQ ID NO: 2658;

(186) an antibody that comprises an L chain having CDR1, CDR2, and CDR3, which are identified in VL comprising the amino acid sequence of SEQ ID NO: 2660;

(187) an antibody that comprises an H chain having CDR1, CDR2, and CDR3, which are identified in VH comprising the amino acid sequence of SEQ ID NO: 2662;

(188) an antibody that comprises an L chain having CDR1, CDR2, and CDR3, which are identified in VL comprising the amino acid sequence of SEQ ID NO: 2664;

(189) an antibody that comprises an H chain having CDR1, CDR2, and CDR3, which are identified in VH comprising the amino acid sequence of SEQ ID NO: 2666;

(190) an antibody that comprises an L chain having CDR1, CDR2, and CDR3, which are identified in VL comprising the amino acid sequence of SEQ ID NO: 2668;

(191) an antibody that comprises an H chain having CDR1, CDR2, and CDR3, which are identified in VH comprising the amino acid sequence of SEQ ID NO: 2670;

(192) an antibody that comprises an L chain having CDR1, CDR2, and CDR3, which are identified in VL comprising the amino acid sequence of SEQ ID NO: 2672;

(193) an antibody that comprises an H chain having CDR1, CDR2, and CDR3, which are identified in VH comprising the amino acid sequence of SEQ ID NO: 2674;

(194) an antibody that comprises an L chain having CDR1, CDR2, and CDR3, which are identified in VL comprising the amino acid sequence of SEQ ID NO: 2676;

(195) an antibody that comprises an H chain having CDR1, CDR2, and CDR3, which are identified in VH comprising the amino acid sequence of SEQ ID NO: 2678;

(196) an antibody that comprises an L chain having CDR1, CDR2, and CDR3, which are identified in VL comprising the amino acid sequence of SEQ ID NO: 2680;

(197) an antibody that comprises an H chain having CDR1, CDR2, and CDR3, which are identified in VH comprising the amino acid sequence of SEQ ID NO: 2682;

(198) an antibody that comprises an L chain having CDR1, CDR2, and CDR3, which are identified in VL comprising the amino acid sequence of SEQ ID NO: 2684;

(199) an antibody that comprises an H chain having CDR1, CDR2, and CDR3, which are identified in VH comprising the amino acid sequence of SEQ ID NO: 2686;

(200) an antibody that comprises an L chain having CDR1, CDR2, and CDR3, which are identified in VL comprising the amino acid sequence of SEQ ID NO: 2688;

(201) an antibody that comprises an H chain having CDR1, CDR2, and CDR3, which are identified in VH comprising the amino acid sequence of SEQ ID NO: 2690;

(202) an antibody that comprises an L chain having CDR1, CDR2, and CDR3, which are identified in VL comprising the amino acid sequence of SEQ ID NO: 2692;

(203) an antibody that comprises an H chain having CDR1, CDR2, and CDR3, which are identified in VH comprising the amino acid sequence of SEQ ID NO: 2694;

(204) an antibody that comprises an L chain having CDR1, CDR2, and CDR3, which are identified in VL comprising the amino acid sequence of SEQ ID NO: 2696;

(205) an antibody that comprises an H chain having CDR1, CDR2, and CDR3, which are identified in VH comprising the amino acid sequence of SEQ ID NO: 2698;

(206) an antibody that comprises an L chain having CDR1, CDR2, and CDR3, which are identified in VL comprising the amino acid sequence of SEQ ID NO: 2700;

(207) an antibody that comprises an H chain having CDR1, CDR2, and CDR3, which are identified in VH comprising the amino acid sequence of SEQ ID NO: 2702;

(208) an antibody that comprises an L chain having CDR1, CDR2, and CDR3, which are identified in VL comprising the amino acid sequence of SEQ ID NO: 2704;

(209) an antibody that comprises an H chain having CDR1, CDR2, and CDR3, which are identified in VH comprising the amino acid sequence of SEQ ID NO: 2706;

(210) an antibody that comprises an L chain having CDR1, CDR2, and CDR3, which are identified in VL comprising the amino acid sequence of SEQ ID NO: 2708;

(211) an antibody that comprises an H chain having CDR1, CDR2, and CDR3, which are identified in VH comprising the amino acid sequence of SEQ ID NO: 2710;

(212) an antibody that comprises an L chain having CDR1, CDR2, and CDR3, which are identified in VL comprising the amino acid sequence of SEQ ID NO: 2712;

(213) an antibody that comprises an H chain having CDR1, CDR2, and CDR3, which are identified in VH comprising the amino acid sequence of SEQ ID NO: 2714;

(214) an antibody that comprises an L chain having CDR1, CDR2, and CDR3, which are identified in VL comprising the amino acid sequence of SEQ ID NO: 2716;

(215) an antibody that comprises an H chain having CDR1, CDR2, and CDR3, which are identified in VH comprising the amino acid sequence of SEQ ID NO: 2718;

(216) an antibody that comprises an L chain having CDR1, CDR2, and CDR3, which are identified in VL comprising the amino acid sequence of SEQ ID NO: 2720;

(217) an antibody that comprises an H chain having CDR1, CDR2, and CDR3, which are identified in VH comprising the amino acid sequence of SEQ ID NO: 2722;

(218) an antibody that comprises an L chain having CDR1, CDR2, and CDR3, which are identified in VL comprising the amino acid sequence of SEQ ID NO: 2724;

(219) an antibody that comprises an H chain having CDR1, CDR2, and CDR3, which are identified in VH comprising the amino acid sequence of SEQ ID NO: 2726;

(220) an antibody that comprises an L chain having CDR1, CDR2, and CDR3, which are identified in VL comprising the amino acid sequence of SEQ ID NO: 2728;

(221) an antibody that comprises an H chain having CDR1, CDR2, and CDR3, which are identified in VH comprising the amino acid sequence of SEQ ID NO: 2730;

(222) an antibody that comprises an L chain having CDR1, CDR2, and CDR3, which are identified in VL comprising the amino acid sequence of SEQ ID NO: 2732;

(223) an antibody that comprises an H chain having CDR1, CDR2, and CDR3, which are identified in VH comprising the amino acid sequence of SEQ ID NO: 2734;

(224) an antibody that comprises an L chain having CDR1, CDR2, and CDR3, which are identified in VL comprising the amino acid sequence of SEQ ID NO: 2736;

(225) an antibody that comprises an H chain having CDR1, CDR2, and CDR3, which are identified in VH comprising the amino acid sequence of SEQ ID NO: 2738;

(226) an antibody that comprises an L chain having CDR1, CDR2, and CDR3, which are identified in VL comprising the amino acid sequence of SEQ ID NO: 2740;

(227) an antibody that comprises an H chain having CDR1, CDR2, and CDR3, which are identified in VH comprising the amino acid sequence of SEQ ID NO: 2742;

(228) an antibody that comprises an L chain having CDR1, CDR2, and CDR3, which are identified in VL comprising the amino acid sequence of SEQ ID NO: 2744;

(229) an antibody that comprises an H chain having CDR1, CDR2, and CDR3, which are identified in VH comprising the amino acid sequence of SEQ ID NO: 2746;

(230) an antibody that comprises an L chain having CDR1, CDR2, and CDR3, which are identified in VL comprising the amino acid sequence of SEQ ID NO: 2748;

(231) an antibody that comprises an H chain having CDR1, CDR2, and CDR3, which are identified in VH comprising the amino acid sequence of SEQ ID NO: 2750;

(232) an antibody that comprises an L chain having CDR1, CDR2, and CDR3, which are identified in VL comprising the amino acid sequence of SEQ ID NO: 2752;

(233) an antibody that comprises an H chain having CDR1, CDR2, and CDR3, which are identified in VH comprising the amino acid sequence of SEQ ID NO: 2754;

(234) an antibody that comprises an L chain having CDR1, CDR2, and CDR3, which are identified in VL comprising the amino acid sequence of SEQ ID NO: 2756;

(235) an antibody that comprises an H chain having CDR1, CDR2, and CDR3, which are identified in VH comprising the amino acid sequence of SEQ ID NO: 2758;

(236) an antibody that comprises an L chain having CDR1, CDR2, and CDR3, which are identified in VL comprising the amino acid sequence of SEQ ID NO: 2760;

(237) an antibody that comprises an H chain having CDR1, CDR2, and CDR3, which are identified in VH comprising the amino acid sequence of SEQ ID NO: 2762;

(238) an antibody that comprises an L chain having CDR1, CDR2, and CDR3, which are identified in VL comprising the amino acid sequence of SEQ ID NO: 2764;

(239) an antibody that comprises an H chain having CDR1, CDR2, and CDR3, which are identified in VH comprising the amino acid sequence of SEQ ID NO: 2766;

(240) an antibody that comprises an L chain having CDR1, CDR2, and CDR3, which are identified in VL comprising the amino acid sequence of SEQ ID NO: 2768;

(241) an antibody that comprises an H chain having CDR1, CDR2, and CDR3, which are identified in VH comprising the amino acid sequence of SEQ ID NO: 2770;

(242) an antibody that comprises an L chain having CDR1, CDR2, and CDR3, which are identified in VL comprising the amino acid sequence of SEQ ID NO: 2772;

(243) an antibody that comprises an H chain having CDR1, CDR2, and CDR3, which are identified in VH comprising the amino acid sequence of SEQ ID NO: 2774;

(244) an antibody that comprises an L chain having CDR1, CDR2, and CDR3, which are identified in VL comprising the amino acid sequence of SEQ ID NO: 2776;

(245) an antibody that comprises an H chain having CDR1, CDR2, and CDR3, which are identified in VH comprising the amino acid sequence of SEQ ID NO: 2778;

(246) an antibody that comprises an L chain having CDR1, CDR2, and CDR3, which are identified in VL comprising the amino acid sequence of SEQ ID NO: 2780;

(247) an antibody that comprises an H chain having CDR1, CDR2, and CDR3, which are identified in VH comprising the amino acid sequence of SEQ ID NO: 2782;

(248) an antibody that comprises an L chain having CDR1, CDR2, and CDR3, which are identified in VL comprising the amino acid sequence of SEQ ID NO: 2784;

(249) an antibody that comprises an H chain having CDR1, CDR2, and CDR3, which are identified in VH comprising the amino acid sequence of SEQ ID NO: 2786;

(250) an antibody that comprises an L chain having CDR1, CDR2, and CDR3, which are identified in VL comprising the amino acid sequence of SEQ ID NO: 2788;

(251) an antibody that comprises an H chain having CDR1, CDR2, and CDR3, which are identified in VH comprising the amino acid sequence of SEQ ID NO: 2790;

(252) an antibody that comprises an L chain having CDR1, CDR2, and CDR3, which are identified in VL comprising the amino acid sequence of SEQ ID NO: 2792;

(253) an antibody that comprises an H chain having CDR1, CDR2, and CDR3, which are identified in VH comprising the amino acid sequence of SEQ ID NO: 2794;

(254) an antibody that comprises an L chain having CDR1, CDR2, and CDR3, which are identified in VL comprising the amino acid sequence of SEQ ID NO: 2796;

(255) an antibody that comprises an H chain having CDR1, CDR2, and CDR3, which are identified in VH comprising the amino acid sequence of SEQ ID NO: 2798;

(256) an antibody that comprises an L chain having CDR1, CDR2, and CDR3, which are identified in VL comprising the amino acid sequence of SEQ ID NO: 2800;

(257) an antibody that comprises an H chain having CDR1, CDR2, and CDR3, which are identified in VH comprising the amino acid sequence of SEQ ID NO: 2802;

(258) an antibody that comprises an L chain having CDR1, CDR2, and CDR3, which are identified in VL comprising the amino acid sequence of SEQ ID NO: 2804;

(259) an antibody that comprises an H chain having CDR1, CDR2, and CDR3, which are identified in VH comprising the amino acid sequence of SEQ ID NO: 2806;

(260) an antibody that comprises an L chain having CDR1, CDR2, and CDR3, which are identified in VL comprising the amino acid sequence of SEQ ID NO: 2808;

(261) an antibody that comprises an H chain having CDR1, CDR2, and CDR3, which are identified in VH comprising the amino acid sequence of SEQ ID NO: 2810;

(262) an antibody that comprises an L chain having CDR1, CDR2, and CDR3, which are identified in VL comprising the amino acid sequence of SEQ ID NO: 2812;

(263) an antibody that comprises an H chain having CDR1, CDR2, and CDR3, which are identified in VH comprising the amino acid sequence of SEQ ID NO: 2814;

(264) an antibody that comprises an L chain having CDR1, CDR2, and CDR3, which are identified in VL comprising the amino acid sequence of SEQ ID NO: 2816;

(265) an antibody that comprises an H chain having CDR1, CDR2, and CDR3, which are identified in VH comprising the amino acid sequence of SEQ ID NO: 2818;

(266) an antibody that comprises an L chain having CDR1, CDR2, and CDR3, which are identified in VL comprising the amino acid sequence of SEQ ID NO: 2820;

(267) an antibody that comprises an H chain having CDR1, CDR2, and CDR3, which are identified in VH comprising the amino acid sequence of SEQ ID NO: 2822;

(268) an antibody that comprises an L chain having CDR1, CDR2, and CDR3, which are identified in VL comprising the amino acid sequence of SEQ ID NO: 2824;

(269) an antibody that comprises an H chain having CDR1, CDR2, and CDR3, which are identified in VH comprising the amino acid sequence of SEQ ID NO: 2826;

(270) an antibody that comprises an L chain having CDR1, CDR2, and CDR3, which are identified in VL comprising the amino acid sequence of SEQ ID NO: 2828;

(271) an antibody that comprises an H chain having CDR1, CDR2, and CDR3, which are identified in VH comprising the amino acid sequence of SEQ ID NO: 2830;

(272) an antibody that comprises an L chain having CDR1, CDR2, and CDR3, which are identified in VL comprising the amino acid sequence of SEQ ID NO: 2832;

(273) an antibody that comprises an H chain having CDR1, CDR2, and CDR3, which are identified in VH comprising the amino acid sequence of SEQ ID NO: 2834;

(274) an antibody that comprises an L chain having CDR1, CDR2, and CDR3, which are identified in VL comprising the amino acid sequence of SEQ ID NO: 2836;

(275) an antibody that comprises an H chain having CDR1, CDR2, and CDR3, which are identified in VH comprising the amino acid sequence of SEQ ID NO: 2838;

(276) an antibody that comprises an L chain having CDR1, CDR2, and CDR3, which are identified in VL comprising the amino acid sequence of SEQ ID NO: 2840;

(277) an antibody that comprises an H chain having CDR1, CDR2, and CDR3, which are identified in VH comprising the amino acid sequence of SEQ ID NO: 2842;

(278) an antibody that comprises an L chain having CDR1, CDR2, and CDR3, which are identified in VL comprising the amino acid sequence of SEQ ID NO: 2844;

(279) an antibody that comprises an H chain having CDR1, CDR2, and CDR3, which are identified in VH comprising the amino acid sequence of SEQ ID NO: 2846;

(280) an antibody that comprises an L chain having CDR1, CDR2, and CDR3, which are identified in VL comprising the amino acid sequence of SEQ ID NO: 2848;

(281) an antibody that comprises an H chain having CDR1, CDR2, and CDR3, which are identified in VH comprising the amino acid sequence of SEQ ID NO: 2850;

(282) an antibody that comprises an L chain having CDR1, CDR2, and CDR3, which are identified in VL comprising the amino acid sequence of SEQ ID NO: 2852;

(283) an antibody that comprises an H chain having CDR1, CDR2, and CDR3, which are identified in VH comprising the amino acid sequence of SEQ ID NO: 2854;

(284) an antibody that comprises an L chain having CDR1, CDR2, and CDR3, which are identified in VL comprising the amino acid sequence of SEQ ID NO: 2856;

(285) an antibody that comprises an H chain having CDR1, CDR2, and CDR3, which are identified in VH comprising the amino acid sequence of SEQ ID NO: 2858;

(286) an antibody that comprises an L chain having CDR1, CDR2, and CDR3, which are identified in VL comprising the amino acid sequence of SEQ ID NO: 2860;

(287) an antibody that comprises an H chain having CDR1, CDR2, and CDR3, which are identified in VH comprising the amino acid sequence of SEQ ID NO: 2862;

(288) an antibody that comprises an L chain having CDR1, CDR2, and CDR3, which are identified in VL comprising the amino acid sequence of SEQ ID NO: 2864;

(289) an antibody that comprises an H chain having CDR1, CDR2, and CDR3, which are identified in VH comprising the amino acid sequence of SEQ ID NO: 2878;

(290) an antibody that comprises an L chain having CDR1, CDR2, and CDR3, which are identified in VL comprising the amino acid sequence of SEQ ID NO: 2880.

As mentioned above, "CDR1, CDR2, and CDR3" refers to CDR determined by a method well-known in the art (e.g., see Kabat, Elvin A., Sequences of proteins of immunological interest 5th ed., National Institutes of Health, 1991; Chothia et al, J Mol Biol 196:901-917, 1987). It is a technical common knowledge in the art that the amino acid sequences of CDR1, CDR2, and CDR3 can be identified in amino acid sequences of regions including CDR1, CDR2, and CDR3, using a method well-known in the art. In the following embodiments, for each antibody, an example of the CDR amino acid sequence determined according to the definition by Kabat is shown.

In a preferred embodiment, the antibody of the present invention is any one of (1) to (872) below.

IR-001 antibody:

(1) an antibody that comprises an H chain having the amino acid sequence of SEQ ID NO: 6 as CDR1, the amino acid sequence of SEQ ID NO: 8 as CDR2, and the amino acid sequence of SEQ ID NO: 10 as CDR3;

(2) an antibody that comprises an L chain having the amino acid sequence of SEQ ID NO: 12 as CDR1, the amino acid sequence of SEQ ID NO: 14 as CDR2, and the amino acid sequence of SEQ ID NO: 16 as CDR3;

(3) an antibody that comprises the H chain of (1) and the L chain of (2);

(4) an antibody that comprises an H chain having the amino acid sequence of SEQ ID NO: 2290 as VH;

(5) an antibody that comprises an L chain having the amino acid sequence of SEQ ID NO: 2292 as VL;

(6) an antibody that comprises the H chain of (4) and the L chain of (5);

IR-002 antibody:

(7) an antibody that comprises an H chain having the amino acid sequence of SEQ ID NO: 22 as CDR1, the amino acid sequence of SEQ ID NO: 24 as CDR2, and the amino acid sequence of SEQ ID NO: 26 as CDR3;

(8) an antibody that comprises an L chain having the amino acid sequence of SEQ ID NO: 28 as CDR1, the amino acid sequence of SEQ ID NO: 30 as CDR2, and the amino acid sequence of SEQ ID NO: 32 as CDR3;

(9) an antibody that comprises the H chain of (7) and the L chain of (8);

(10) an antibody that comprises an H chain having the amino acid sequence of SEQ ID NO: 2294 as VH;

(11) an antibody that comprises an L chain having the amino acid sequence of SEQ ID NO: 2296 as VL;

(12) an antibody that comprises the H chain of (10) and the L chain of (11);

IR-004 antibody:

(13) an antibody that comprises an H chain having the amino acid sequence of SEQ ID NO: 38 as CDR1, the amino acid sequence of SEQ ID NO: 40 as CDR2, and the amino acid sequence of SEQ ID NO: 42 as CDR3;

(14) an antibody that comprises an L chain having the amino acid sequence of SEQ ID NO: 44 as CDR1, the amino acid sequence of SEQ ID NO: 46 as CDR2, and the amino acid sequence of SEQ ID NO: 48 as CDR3;

(15) an antibody that comprises the H chain of (13) and the L chain of (14);

(16) an antibody that comprises an H chain having the amino acid sequence of SEQ ID NO: 2298 as VH;

(17) an antibody that comprises an L chain having the amino acid sequence of SEQ ID NO: 2300 as VL;

(18) an antibody that comprises the H chain of (16) and the L chain of (17);

IR-005 antibody:

(19) an antibody that comprises an H chain having the amino acid sequence of SEQ ID NO: 54 as CDR1, the amino acid sequence of SEQ ID NO: 56 as CDR2, and the amino acid sequence of SEQ ID NO: 58 as CDR3;

(20) an antibody that comprises an L chain having the amino acid sequence of SEQ ID NO: 60 as CDR1, the amino acid sequence of SEQ ID NO: 62 as CDR2, and the amino acid sequence of SEQ ID NO: 64 as CDR3;

(21) an antibody that comprises the H chain of (19) and the L chain of (20);

(22) an antibody that comprises an H chain having the amino acid sequence of SEQ ID NO: 2302 as VH;

(23) an antibody that comprises an L chain having the amino acid sequence of SEQ ID NO: 2304 as VL;

(24) an antibody that comprises the H chain of (22) and the L chain of (23);

IR-006 antibody:

(25) an antibody that comprises an H chain having the amino acid sequence of SEQ ID NO: 70 as CDR1, the amino acid sequence of SEQ ID NO: 72 as CDR2, and the amino acid sequence of SEQ ID NO: 74 as CDR3;

(26) an antibody that comprises an L chain having the amino acid sequence of SEQ ID NO: 76 as CDR1, the amino acid sequence of SEQ ID NO: 78 as CDR2, and the amino acid sequence of SEQ ID NO: 80 as CDR3;

(27) an antibody that comprises the H chain of (25) and the L chain of (26);

(28) an antibody that comprises an H chain having the amino acid sequence of SEQ ID NO: 2306 as VH;

(29) an antibody that comprises an L chain having the amino acid sequence of SEQ ID NO: 2308 as VL;

(30) an antibody that comprises the H chain of (28) and the L chain of (29);

IR-007 antibody:

(31) an antibody that comprises an H chain having the amino acid sequence of SEQ ID NO: 86 as CDR1, the amino acid sequence of SEQ ID NO: 88 as CDR2, and the amino acid sequence of SEQ ID NO: 90 as CDR3;

(32) an antibody that comprises an L chain having the amino acid sequence of SEQ ID NO: 92 as CDR1, the amino acid sequence of SEQ ID NO: 94 as CDR2, and the amino acid sequence of SEQ ID NO: 96 as CDR3;

(33) an antibody that comprises the H chain of (31) and the L chain of (32);

(34) an antibody that comprises an H chain having the amino acid sequence of SEQ ID NO: 2310 as VH;

(35) an antibody that comprises an L chain having the amino acid sequence of SEQ ID NO: 2312 as VL;

(36) an antibody that comprises the H chain of (34) and the L chain of (35);

IR-008 antibody:

(37) an antibody that comprises an H chain having the amino acid sequence of SEQ ID NO: 102 as CDR1, the amino acid sequence of SEQ ID NO: 104 as CDR2, and the amino acid sequence of SEQ ID NO: 106 as CDR3;

(38) an antibody that comprises an L chain having the amino acid sequence of SEQ ID NO: 108 as CDR1, the amino acid sequence of SEQ ID NO: 110 as CDR2, and the amino acid sequence of SEQ ID NO: 112 as CDR3;

(39) an antibody that comprises the H chain of (37) and the L chain of (38);

(40) an antibody that comprises an H chain having the amino acid sequence of SEQ ID NO: 2314 as VH;

(41) an antibody that comprises an L chain having the amino acid sequence of SEQ ID NO: 2316 as VL;

(42) an antibody that comprises the H chain of (40) and the L chain of (41);

IR-011 antibody:

(43) an antibody that comprises an H chain having the amino acid sequence of SEQ ID NO: 118 as CDR1, the amino acid sequence of SEQ ID NO: 120 as CDR2, and the amino acid sequence of SEQ ID NO: 122 as CDR3;

(44) an antibody that comprises an L chain having the amino acid sequence of SEQ ID NO: 124 as CDR1, the amino acid sequence of SEQ ID NO: 126 as CDR2, and the amino acid sequence of SEQ ID NO: 128 as CDR3;

(45) an antibody that comprises the H chain of (43) and the L chain of (44);

(46) an antibody that comprises an H chain having the amino acid sequence of SEQ ID NO: 2318 as VH;

(47) an antibody that comprises an L chain having the amino acid sequence of SEQ ID NO: 2320 as VL;

(48) an antibody that comprises the H chain of (46) and the L chain of (47);

IR-012 antibody:

(49) an antibody that comprises an H chain having the amino acid sequence of SEQ ID NO: 134 as CDR1, the amino acid sequence of SEQ ID NO: 136 as CDR2, and the amino acid sequence of SEQ ID NO: 138 as CDR3;

(50) an antibody that comprises an L chain having the amino acid sequence of SEQ ID NO: 140 as CDR1, the amino acid sequence of SEQ ID NO: 142 as CDR2, and the amino acid sequence of SEQ ID NO: 144 as CDR3;

(51) an antibody that comprises the H chain of (49) and the L chain of (50);

(52) an antibody that comprises an H chain having the amino acid sequence of SEQ ID NO: 2322 as VH;

(53) an antibody that comprises an L chain having the amino acid sequence of SEQ ID NO: 2324 as VL;

(54) an antibody that comprises the H chain of (52) and the L chain of (53);

IR-013 antibody:

(55) an antibody that comprises an H chain having the amino acid sequence of SEQ ID NO: 150 as CDR1, the amino acid sequence of SEQ ID NO: 152 as CDR2, and the amino acid sequence of SEQ ID NO: 154 as CDR3;

(56) an antibody that comprises an L chain having the amino acid sequence of SEQ ID NO: 156 as CDR1, the amino acid sequence of SEQ ID NO: 158 as CDR2, and the amino acid sequence of SEQ ID NO: 160 as CDR3;

(57) an antibody that comprises the H chain of (55) and the L chain of (56);

(58) an antibody that comprises an H chain having the amino acid sequence of SEQ ID NO: 2326 as VH;

(59) an antibody that comprises an L chain having the amino acid sequence of SEQ ID NO: 2328 as VL;

(60) an antibody that comprises the H chain of (58) and the L chain of (59);

IR-014 antibody:

(61) an antibody that comprises an H chain having the amino acid sequence of SEQ ID NO: 166 as CDR1, the amino acid sequence of SEQ ID NO: 168 as CDR2, and the amino acid sequence of SEQ ID NO: 170 as CDR3;

(62) an antibody that comprises an L chain having the amino acid sequence of SEQ ID NO: 172 as CDR1, the amino acid sequence of SEQ ID NO: 174 as CDR2, and the amino acid sequence of SEQ ID NO: 176 as CDR3;

(63) an antibody that comprises the H chain of (61) and the L chain of (62);

(64) an antibody that comprises an H chain having the amino acid sequence of SEQ ID NO: 2330 as VH;

(65) an antibody that comprises an L chain having the amino acid sequence of SEQ ID NO: 2332 as VL;

(66) an antibody that comprises the H chain of (64) and the L chain of (65);

IR-015 antibody:

(67) an antibody that comprises an H chain having the amino acid sequence of SEQ ID NO: 182 as CDR1, the amino acid sequence of SEQ ID NO: 184 as CDR2, and the amino acid sequence of SEQ ID NO: 186 as CDR3;

(68) an antibody that comprises an L chain having the amino acid sequence of SEQ ID NO: 188 as CDR1, the amino acid sequence of SEQ ID NO: 190 as CDR2, and the amino acid sequence of SEQ ID NO: 192 as CDR3;

(69) an antibody that comprises the H chain of (67) and the L chain of (68);

(70) an antibody that comprises an H chain having the amino acid sequence of SEQ ID NO: 2334 as VH;

(71) an antibody that comprises an L chain having the amino acid sequence of SEQ ID NO: 2336 as VL;

(72) an antibody that comprises the H chain of (70) and the L chain of (71);

IR-017 antibody:

(73) an antibody that comprises an H chain having the amino acid sequence of SEQ ID NO: 198 as CDR1, the amino acid sequence of SEQ ID NO: 200 as CDR2, and the amino acid sequence of SEQ ID NO: 202 as CDR3;

(74) an antibody that comprises an L chain having the amino acid sequence of SEQ ID NO: 204 as CDR1, the amino acid sequence of SEQ ID NO: 206 as CDR2, and the amino acid sequence of SEQ ID NO: 208 as CDR3;

(75) an antibody that comprises the H chain of (73) and the L chain of (74);

(76) an antibody that comprises an H chain having the amino acid sequence of SEQ ID NO: 2338 as VH;

(77) an antibody that comprises an L chain having the amino acid sequence of SEQ ID NO: 2340 as VL;

(78) an antibody that comprises the H chain of (76) and the L chain of (77);

IR-020 antibody:

(79) an antibody that comprises an H chain having the amino acid sequence of SEQ ID NO: 214 as CDR1, the amino acid sequence of SEQ ID NO: 216 as CDR2, and the amino acid sequence of SEQ ID NO: 218 as CDR3;

(80) an antibody that comprises an L chain having the amino acid sequence of SEQ ID NO: 220 as CDR1, the amino acid sequence of SEQ ID NO: 222 as CDR2, and the amino acid sequence of SEQ ID NO: 224 as CDR3;

(81) an antibody that comprises the H chain of (79) and the L chain of (80);

(82) an antibody that comprises an H chain having the amino acid sequence of SEQ ID NO: 2342 as VH;

(83) an antibody that comprises an L chain having the amino acid sequence of SEQ ID NO: 2344 as VL;

(84) an antibody that comprises the H chain of (82) and the L chain of (83);

IR-021 antibody:

(85) an antibody that comprises an H chain having the amino acid sequence of SEQ ID NO: 230 as CDR1, the amino acid sequence of SEQ ID NO: 232 as CDR2, and the amino acid sequence of SEQ ID NO: 234 as CDR3;

(86) an antibody that comprises an L chain having the amino acid sequence of SEQ ID NO: 236 as CDR1, the amino acid sequence of SEQ ID NO: 238 as CDR2, and the amino acid sequence of SEQ ID NO: 240 as CDR3;

(87) an antibody that comprises the H chain of (85) and the L chain of (86);

(88) an antibody that comprises an H chain having the amino acid sequence of SEQ ID NO: 2346 as VH;

(89) an antibody that comprises an L chain having the amino acid sequence of SEQ ID NO: 2348 as VL;

(90) an antibody that comprises the H chain of (88) and the L chain of (89);

IR-022 antibody:

(91) an antibody that comprises an H chain having the amino acid sequence of SEQ ID NO: 246 as CDR1, the amino acid sequence of SEQ ID NO: 248 as CDR2, and the amino acid sequence of SEQ ID NO: 250 as CDR3;

(92) an antibody that comprises an L chain having the amino acid sequence of SEQ ID NO: 252 as CDR1, the amino acid sequence of SEQ ID NO: 254 as CDR2, and the amino acid sequence of SEQ ID NO: 256 as CDR3;

(93) an antibody that comprises the H chain of (91) and the L chain of (92);

(94) an antibody that comprises an H chain having the amino acid sequence of SEQ ID NO: 2350 as VH;

(95) an antibody that comprises an L chain having the amino acid sequence of SEQ ID NO: 2352 as VL;

(96) an antibody that comprises the H chain of (94) and the L chain of (95);

IR-023 antibody:

(97) an antibody that comprises an H chain having the amino acid sequence of SEQ ID NO: 262 as CDR1, the amino acid sequence of SEQ ID NO: 264 as CDR2, and the amino acid sequence of SEQ ID NO: 266 as CDR3;

(98) an antibody that comprises an L chain having the amino acid sequence of SEQ ID NO: 268 as CDR1, the amino acid sequence of SEQ ID NO: 270 as CDR2, and the amino acid sequence of SEQ ID NO: 272 as CDR3;

(99) an antibody that comprises the H chain of (97) and the L chain of (98);

(100) an antibody that comprises an H chain having the amino acid sequence of SEQ ID NO: 2354 as VH;

(101) an antibody that comprises an L chain having the amino acid sequence of SEQ ID NO: 2356 as VL;

(102) an antibody that comprises the H chain of (100) and the L chain of (101);

IR-024 antibody:

(103) an antibody that comprises an H chain having the amino acid sequence of SEQ ID NO: 278 as CDR1, the amino acid sequence of SEQ ID NO: 280 as CDR2, and the amino acid sequence of SEQ ID NO: 282 as CDR3;

(104) an antibody that comprises an L chain having the amino acid sequence of SEQ ID NO: 284 as CDR1, the amino acid sequence of SEQ ID NO: 286 as CDR2, and the amino acid sequence of SEQ ID NO: 288 as CDR3;

(105) an antibody that comprises the H chain of (103) and the L chain of (104);

(106) an antibody that comprises an H chain having the amino acid sequence of SEQ ID NO: 2358 as VH;

(107) an antibody that comprises an L chain having the amino acid sequence of SEQ ID NO: 2360 as VL;

(108) an antibody that comprises the H chain of (106) and the L chain of (107);

IR-025 antibody:

(109) an antibody that comprises an H chain having the amino acid sequence of SEQ ID NO: 294 as CDR1, the amino acid sequence of SEQ ID NO: 296 as CDR2, and the amino acid sequence of SEQ ID NO: 298 as CDR3;

(110) an antibody that comprises an L chain having the amino acid sequence of SEQ ID NO: 300 as CDR1, the amino acid sequence of SEQ ID NO: 302 as CDR2, and the amino acid sequence of SEQ ID NO: 304 as CDR3;

(111) an antibody that comprises the H chain of (109) and the L chain of (110);

(112) an antibody that comprises an H chain having the amino acid sequence of SEQ ID NO: 2362 as VH;

(113) an antibody that comprises an L chain having the amino acid sequence of SEQ ID NO: 2364 as VL;

(114) an antibody that comprises the H chain of (112) and the L chain of (113);

IR-026 antibody:

(115) an antibody that comprises an H chain having the amino acid sequence of SEQ ID NO: 310 as CDR1, the amino acid sequence of SEQ ID NO: 312 as CDR2, and the amino acid sequence of SEQ ID NO: 314 as CDR3;

(116) an antibody that comprises an L chain having the amino acid sequence of SEQ ID NO: 316 as CDR1, the amino acid sequence of SEQ ID NO: 318 as CDR2, and the amino acid sequence of SEQ ID NO: 320 as CDR3;

(117) an antibody that comprises the H chain of (115) and the L chain of (116);

(118) an antibody that comprises an H chain having the amino acid sequence of SEQ ID NO: 2366 as VH;

(119) an antibody that comprises an L chain having the amino acid sequence of SEQ ID NO: 2368 as VL;

(120) an antibody that comprises the H chain of (118) and the L chain of (119);

IR-027 antibody:

(121) an antibody that comprises an H chain having the amino acid sequence of SEQ ID NO: 326 as CDR1, the amino acid sequence of SEQ ID NO: 328 as CDR2, and the amino acid sequence of SEQ ID NO: 330 as CDR3;

(122) an antibody that comprises an L chain having the amino acid sequence of SEQ ID NO: 332 as CDR1, the amino acid sequence of SEQ ID NO: 334 as CDR2, and the amino acid sequence of SEQ ID NO: 336 as CDR3;

(123) an antibody that comprises the H chain of (121) and the L chain of (122);

(124) an antibody that comprises an H chain having the amino acid sequence of SEQ ID NO: 2370 as VH;

(125) an antibody that comprises an L chain having the amino acid sequence of SEQ ID NO: 2372 as VL;

(126) an antibody that comprises the H chain of (124) and the L chain of (125);

IR-028 antibody:

(127) an antibody that comprises an H chain having the amino acid sequence of SEQ ID NO: 342 as CDR1, the amino acid sequence of SEQ ID NO: 344 as CDR2, and the amino acid sequence of SEQ ID NO: 346 as CDR3;

(128) an antibody that comprises an L chain having the amino acid sequence of SEQ ID NO: 348 as CDR1, the amino acid sequence of SEQ ID NO: 350 as CDR2, and the amino acid sequence of SEQ ID NO: 352 as CDR3;

(129) an antibody that comprises the H chain of (127) and the L chain of (128);

(130) an antibody that comprises an H chain having the amino acid sequence of SEQ ID NO: 2374 as VH;

(131) an antibody that comprises an L chain having the amino acid sequence of SEQ ID NO: 2376 as VL;

(132) an antibody that comprises the H chain of (130) and the L chain of (131);

IR-029 antibody:

(133) an antibody that comprises an H chain having the amino acid sequence of SEQ ID NO: 358 as CDR1, the amino acid sequence of SEQ ID NO: 360 as CDR2, and the amino acid sequence of SEQ ID NO: 362 as CDR3;

(134) an antibody that comprises an L chain having the amino acid sequence of SEQ ID NO: 364 as CDR1, the amino acid sequence of SEQ ID NO: 366 as CDR2, and the amino acid sequence of SEQ ID NO: 368 as CDR3;

(135) an antibody that comprises the H chain of (133) and the L chain of (134);

(136) an antibody that comprises an H chain having the amino acid sequence of SEQ ID NO: 2378 as VH;

(137) an antibody that comprises an L chain having the amino acid sequence of SEQ ID NO: 2380 as VL;

(138) an antibody that comprises the H chain of (136) and the L chain of (137);

IR-030 antibody:

(139) an antibody that comprises an H chain having the amino acid sequence of SEQ ID NO: 374 as CDR1, the amino acid sequence of SEQ ID NO: 376 as CDR2, and the amino acid sequence of SEQ ID NO: 378 as CDR3;

(140) an antibody that comprises an L chain having the amino acid sequence of SEQ ID NO: 380 as CDR1, the amino acid sequence of SEQ ID NO: 382 as CDR2, and the amino acid sequence of SEQ ID NO: 384 as CDR3;

(141) an antibody that comprises the H chain of (139) and the L chain of (140);

(142) an antibody that comprises an H chain having the amino acid sequence of SEQ ID NO: 2382 as VH;

(143) an antibody that comprises an L chain having the amino acid sequence of SEQ ID NO: 2384 as VL;

(144) an antibody that comprises the H chain of (142) and the L chain of (143);

IR-031 antibody:

(145) an antibody that comprises an H chain having the amino acid sequence of SEQ ID NO: 390 as CDR1, the amino acid sequence of SEQ ID NO: 392 as CDR2, and the amino acid sequence of SEQ ID NO: 394 as CDR3;

(146) an antibody that comprises an L chain having the amino acid sequence of SEQ ID NO: 396 as CDR1, the amino acid sequence of SEQ ID NO: 398 as CDR2, and the amino acid sequence of SEQ ID NO: 400 as CDR3;

(147) an antibody that comprises the H chain of (145) and the L chain of (146);

(148) an antibody that comprises an H chain having the amino acid sequence of SEQ ID NO: 2386 as VH;

(149) an antibody that comprises an L chain having the amino acid sequence of SEQ ID NO: 2388 as VL;

(150) an antibody that comprises the H chain of (148) and the L chain of (149);

IR-032 antibody:

(151) an antibody that comprises an H chain having the amino acid sequence of SEQ ID NO: 406 as CDR1, the amino acid sequence of SEQ ID NO: 408 as CDR2, and the amino acid sequence of SEQ ID NO: 410 as CDR3;

(152) an antibody that comprises an L chain having the amino acid sequence of SEQ ID NO: 412 as CDR1, the amino acid sequence of SEQ ID NO: 414 as CDR2, and the amino acid sequence of SEQ ID NO: 416 as CDR3;

(153) an antibody that comprises the H chain of (151) and the L chain of (152);

(154) an antibody that comprises an H chain having the amino acid sequence of SEQ ID NO: 2390 as VH;

(155) an antibody that comprises an L chain having the amino acid sequence of SEQ ID NO: 2392 as VL;

(156) an antibody that comprises the H chain of (154) and the L chain of (155);

IR-033 antibody:

(157) an antibody that comprises an H chain having the amino acid sequence of SEQ ID NO: 422 as CDR1, the amino acid sequence of SEQ ID NO: 424 as CDR2, and the amino acid sequence of SEQ ID NO: 426 as CDR3;

(158) an antibody that comprises an L chain having the amino acid sequence of SEQ ID NO: 428 as CDR1, the amino acid sequence of SEQ ID NO: 430 as CDR2, and the amino acid sequence of SEQ ID NO: 432 as CDR3;

(159) an antibody that comprises the H chain of (157) and the L chain of (158);

(160) an antibody that comprises an H chain having the amino acid sequence of SEQ ID NO: 2394 as VH;

(161) an antibody that comprises an L chain having the amino acid sequence of SEQ ID NO: 2396 as VL;

(162) an antibody that comprises the H chain of (160) and the L chain of (161);

IR-034 antibody:

(163) an antibody that comprises an H chain having the amino acid sequence of SEQ ID NO: 438 as CDR1, the amino acid sequence of SEQ ID NO: 440 as CDR2, and the amino acid sequence of SEQ ID NO: 442 as CDR3;

(164) an antibody that comprises an L chain having the amino acid sequence of SEQ ID NO: 444 as CDR1, the amino acid sequence of SEQ ID NO: 446 as CDR2, and the amino acid sequence of SEQ ID NO: 448 as CDR3;

(165) an antibody that comprises the H chain of (163) and the L chain of (164);

(166) an antibody that comprises an H chain having the amino acid sequence of SEQ ID NO: 2398 as VH;

(167) an antibody that comprises an L chain having the amino acid sequence of SEQ ID NO: 2400 as VL;

(168) an antibody that comprises the H chain of (166) and the L chain of (167);

IR-035 antibody:

(169) an antibody that comprises an H chain having the amino acid sequence of SEQ ID NO: 454 as CDR1, the amino acid sequence of SEQ ID NO: 456 as CDR2, and the amino acid sequence of SEQ ID NO: 458 as CDR3;

(170) an antibody that comprises an L chain having the amino acid sequence of SEQ ID NO: 460 as CDR1, the amino acid sequence of SEQ ID NO: 462 as CDR2, and the amino acid sequence of SEQ ID NO: 464 as CDR3;

(171) an antibody that comprises the H chain of (169) and the L chain of (170);

(172) an antibody that comprises an H chain having the amino acid sequence of SEQ ID NO: 2402 as VH;

(173) an antibody that comprises an L chain having the amino acid sequence of SEQ ID NO: 2404 as VL;

(174) an antibody that comprises the H chain of (172) and the L chain of (173);

IR-036 antibody:

(175) an antibody that comprises an H chain having the amino acid sequence of SEQ ID NO: 470 as CDR1, the amino acid sequence of SEQ ID NO: 472 as CDR2, and the amino acid sequence of SEQ ID NO: 474 as CDR3;

(176) an antibody that comprises an L chain having the amino acid sequence of SEQ ID NO: 476 as CDR1, the amino acid sequence of SEQ ID NO: 478 as CDR2, and the amino acid sequence of SEQ ID NO: 480 as CDR3;

(177) an antibody that comprises the H chain of (175) and the L chain of (176);

(178) an antibody that comprises an H chain having the amino acid sequence of SEQ ID NO: 2406 as VH;

(179) an antibody that comprises an L chain having the amino acid sequence of SEQ ID NO: 2408 as VL;

(180) an antibody that comprises the H chain of (178) and the L chain of (179);

IR-037 antibody:

(181) an antibody that comprises an H chain having the amino acid sequence of SEQ ID NO: 486 as CDR1, the amino acid sequence of SEQ ID NO: 488 as CDR2, and the amino acid sequence of SEQ ID NO: 490 as CDR3;

(182) an antibody that comprises an L chain having the amino acid sequence of SEQ ID NO: 492 as CDR1, the amino acid sequence of SEQ ID NO: 494 as CDR2, and the amino acid sequence of SEQ ID NO: 496 as CDR3;

(183) an antibody that comprises the H chain of (181) and the L chain of (182);

(184) an antibody that comprises an H chain having the amino acid sequence of SEQ ID NO: 2410 as VH;

(185) an antibody that comprises an L chain having the amino acid sequence of SEQ ID NO: 2412 as VL;

(186) an antibody that comprises the H chain of (184) and the L chain of (185);

IR-038 antibody:

(187) an antibody that comprises an H chain having the amino acid sequence of SEQ ID NO: 502 as CDR1, the amino acid sequence of SEQ ID NO: 504 as CDR2, and the amino acid sequence of SEQ ID NO: 506 as CDR3;

(188) an antibody that comprises an L chain having the amino acid sequence of SEQ ID NO: 508 as CDR1, the amino acid sequence of SEQ ID NO: 510 as CDR2, and the amino acid sequence of SEQ ID NO: 512 as CDR3;

(189) an antibody that comprises the H chain of (187) and the L chain of (188);

(190) an antibody that comprises an H chain having the amino acid sequence of SEQ ID NO: 2414 as VH;

(191) an antibody that comprises an L chain having the amino acid sequence of SEQ ID NO: 2416 as VL;

(192) an antibody that comprises the H chain of (190) and the L chain of (191);

IR-039 antibody:

(193) an antibody that comprises an H chain having the amino acid sequence of SEQ ID NO: 518 as CDR1, the amino acid sequence of SEQ ID NO: 520 as CDR2, and the amino acid sequence of SEQ ID NO: 522 as CDR3;

(194) an antibody that comprises an L chain having the amino acid sequence of SEQ ID NO: 524 as CDR1, the amino acid sequence of SEQ ID NO: 526 as CDR2, and the amino acid sequence of SEQ ID NO: 528 as CDR3;

(195) an antibody that comprises the H chain of (193) and the L chain of (194);

(196) an antibody that comprises an H chain having the amino acid sequence of SEQ ID NO: 2418 as VH;

(197) an antibody that comprises an L chain having the amino acid sequence of SEQ ID NO: 2420 as VL;

(198) an antibody that comprises the H chain of (196) and the L chain of (197);

IR-040 antibody:

(199) an antibody that comprises an H chain having the amino acid sequence of SEQ ID NO: 534 as CDR1, the amino acid sequence of SEQ ID NO: 536 as CDR2, and the amino acid sequence of SEQ ID NO: 538 as CDR3;

(200) an antibody that comprises an L chain having the amino acid sequence of SEQ ID NO: 540 as CDR1, the amino acid sequence of SEQ ID NO: 542 as CDR2, and the amino acid sequence of SEQ ID NO: 544 as CDR3;

(201) an antibody that comprises the H chain of (199) and the L chain of (200);

(202) an antibody that comprises an H chain having the amino acid sequence of SEQ ID NO: 2422 as VH;

(203) an antibody that comprises an L chain having the amino acid sequence of SEQ ID NO: 2424 as VL;

(204) an antibody that comprises the H chain of (202) and the L chain of (203);

IR-041 antibody:

(205) an antibody that comprises an H chain having the amino acid sequence of SEQ ID NO: 550 as CDR1, the amino acid sequence of SEQ ID NO: 552 as CDR2, and the amino acid sequence of SEQ ID NO: 554 as CDR3;

(206) an antibody that comprises an L chain having the amino acid sequence of SEQ ID NO: 556 as CDR1, the amino acid sequence of SEQ ID NO: 558 as CDR2, and the amino acid sequence of SEQ ID NO: 560 as CDR3;

(207) an antibody that comprises the H chain of (205) and the L chain of (206);

(208) an antibody that comprises an H chain having the amino acid sequence of SEQ ID NO: 2426 as VH;

(209) an antibody that comprises an L chain having the amino acid sequence of SEQ ID NO: 2428 as VL;

(210) an antibody that comprises the H chain of (208) and the L chain of (209);

IR-043 antibody:

(211) an antibody that comprises an H chain having the amino acid sequence of SEQ ID NO: 566 as CDR1, the amino acid sequence of SEQ ID NO: 568 as CDR2, and the amino acid sequence of SEQ ID NO: 570 as CDR3;

(212) an antibody that comprises an L chain having the amino acid sequence of SEQ ID NO: 572 as CDR1, the amino acid sequence of SEQ ID NO: 574 as CDR2, and the amino acid sequence of SEQ ID NO: 576 as CDR3;

(213) an antibody that comprises the H chain of (211) and the L chain of (212);

(214) an antibody that comprises an H chain having the amino acid sequence of SEQ ID NO: 2430 as VH;

(215) an antibody that comprises an L chain having the amino acid sequence of SEQ ID NO: 2432 as VL;

(216) an antibody that comprises the H chain of (214) and the L chain of (215);

IR-044 antibody:

(217) an antibody that comprises an H chain having the amino acid sequence of SEQ ID NO: 582 as CDR1, the amino acid sequence of SEQ ID NO: 584 as CDR2, and the amino acid sequence of SEQ ID NO: 586 as CDR3;

(218) an antibody that comprises an L chain having the amino acid sequence of SEQ ID NO: 588 as CDR1, the amino acid sequence of SEQ ID NO: 590 as CDR2, and the amino acid sequence of SEQ ID NO: 592 as CDR3;

(219) an antibody that comprises the H chain of (217) and the L chain of (218);

(220) an antibody that comprises an H chain having the amino acid sequence of SEQ ID NO: 2434 as VH;

(221) an antibody that comprises an L chain having the amino acid sequence of SEQ ID NO: 2436 as VL;

(222) an antibody that comprises the H chain of (220) and the L chain of (221);

IR-045 antibody:

(223) an antibody that comprises an H chain having the amino acid sequence of SEQ ID NO: 598 as CDR1, the amino acid sequence of SEQ ID NO: 600 as CDR2, and the amino acid sequence of SEQ ID NO: 602 as CDR3;

(224) an antibody that comprises an L chain having the amino acid sequence of SEQ ID NO: 604 as CDR1, the amino acid sequence of SEQ ID NO: 606 as CDR2, and the amino acid sequence of SEQ ID NO: 608 as CDR3;

(225) an antibody that comprises the H chain of (223) and the L chain of (224);

(226) an antibody that comprises an H chain having the amino acid sequence of SEQ ID NO: 2438 as VH;

(227) an antibody that comprises an L chain having the amino acid sequence of SEQ ID NO: 2440 as VL;

(228) an antibody that comprises the H chain of (226) and the L chain of (227);

IR-046 antibody:

(229) an antibody that comprises an H chain having the amino acid sequence of SEQ ID NO: 614 as CDR1, the amino acid sequence of SEQ ID NO: 616 as CDR2, and the amino acid sequence of SEQ ID NO: 618 as CDR3;

(230) an antibody that comprises an L chain having the amino acid sequence of SEQ ID NO: 620 as CDR1, the amino acid sequence of SEQ ID NO: 622 as CDR2, and the amino acid sequence of SEQ ID NO: 624 as CDR3;

(231) an antibody that comprises the H chain of (229) and the L chain of (230);

(232) an antibody that comprises an H chain having the amino acid sequence of SEQ ID NO: 2442 as VH;

(233) an antibody that comprises an L chain having the amino acid sequence of SEQ ID NO: 2444 as VL;

(234) an antibody that comprises the H chain of (232) and the L chain of (233);

IR-048 antibody:

(235) an antibody that comprises an H chain having the amino acid sequence of SEQ ID NO: 630 as CDR1, the amino acid sequence of SEQ ID NO: 632 as CDR2, and the amino acid sequence of SEQ ID NO: 634 as CDR3;

(236) an antibody that comprises an L chain having the amino acid sequence of SEQ ID NO: 636 as CDR1, the amino acid sequence of SEQ ID NO: 638 as CDR2, and the amino acid sequence of SEQ ID NO: 640 as CDR3;

(237) an antibody that comprises the H chain of (235) and the L chain of (236);

(238) an antibody that comprises an H chain having the amino acid sequence of SEQ ID NO: 2446 as VH;

(239) an antibody that comprises an L chain having the amino acid sequence of SEQ ID NO: 2448 as VL;

(240) an antibody that comprises the H chain of (238) and the L chain of (239);

IR-049 antibody:

(241) an antibody that comprises an H chain having the amino acid sequence of SEQ ID NO: 646 as CDR1, the amino acid sequence of SEQ ID NO: 648 as CDR2, and the amino acid sequence of SEQ ID NO: 650 as CDR3;

(242) an antibody that comprises an L chain having the amino acid sequence of SEQ ID NO: 652 as CDR1, the amino acid sequence of SEQ ID NO: 654 as CDR2, and the amino acid sequence of SEQ ID NO: 656 as CDR3;

(243) an antibody that comprises the H chain of (241) and the L chain of (242);

(244) an antibody that comprises an H chain having the amino acid sequence of SEQ ID NO: 2450 as VH;

(245) an antibody that comprises an L chain having the amino acid sequence of SEQ ID NO: 2452 as VL;

(246) an antibody that comprises the H chain of (244) and the L chain of (245);

IR-050 antibody:

(247) an antibody that comprises an H chain having the amino acid sequence of SEQ ID NO: 662 as CDR1, the amino acid sequence of SEQ ID NO: 664 as CDR2, and the amino acid sequence of SEQ ID NO: 666 as CDR3;

(248) an antibody that comprises an L chain having the amino acid sequence of SEQ ID NO: 668 as CDR1, the amino acid sequence of SEQ ID NO: 670 as CDR2, and the amino acid sequence of SEQ ID NO: 672 as CDR3;

(249) an antibody that comprises the H chain of (247) and the L chain of (248);

(250) an antibody that comprises an H chain having the amino acid sequence of SEQ ID NO: 2454 as VH;

(251) an antibody that comprises an L chain having the amino acid sequence of SEQ ID NO: 2456 as VL;

(252) an antibody that comprises the H chain of (250) and the L chain of (251);

IR-051 antibody:

(253) an antibody that comprises an H chain having the amino acid sequence of SEQ ID NO: 678 as CDR1, the amino acid sequence of SEQ ID NO: 680 as CDR2, and the amino acid sequence of SEQ ID NO: 682 as CDR3;

(254) an antibody that comprises an L chain having the amino acid sequence of SEQ ID NO: 684 as CDR1, the amino acid sequence of SEQ ID NO: 686 as CDR2, and the amino acid sequence of SEQ ID NO: 688 as CDR3;

(255) an antibody that comprises the H chain of (253) and the L chain of (254);

(256) an antibody that comprises an H chain having the amino acid sequence of SEQ ID NO: 2458 as VH;

(257) an antibody that comprises an L chain having the amino acid sequence of SEQ ID NO: 2460 as VL;

(258) an antibody that comprises the H chain of (256) and the L chain of (257);

IR-052 antibody:

(259) an antibody that comprises an H chain having the amino acid sequence of SEQ ID NO: 694 as CDR1, the amino acid sequence of SEQ ID NO: 696 as CDR2, and the amino acid sequence of SEQ ID NO: 698 as CDR3;

(260) an antibody that comprises an L chain having the amino acid sequence of SEQ ID NO: 700 as CDR1, the amino acid sequence of SEQ ID NO: 702 as CDR2, and the amino acid sequence of SEQ ID NO: 704 as CDR3;

(261) an antibody that comprises the H chain of (259) and the L chain of (260);

(262) an antibody that comprises an H chain having the amino acid sequence of SEQ ID NO: 2462 as VH;

(263) an antibody that comprises an L chain having the amino acid sequence of SEQ ID NO: 2464 as VL;

(264) an antibody that comprises the H chain of (262) and the L chain of (263);

IR-053 antibody:

(265) an antibody that comprises an H chain having the amino acid sequence of SEQ ID NO: 710 as CDR1, the amino acid sequence of SEQ ID NO: 712 as CDR2, and the amino acid sequence of SEQ ID NO: 714 as CDR3;

(266) an antibody that comprises an L chain having the amino acid sequence of SEQ ID NO: 716 as CDR1, the amino acid sequence of SEQ ID NO: 718 as CDR2, and the amino acid sequence of SEQ ID NO: 720 as CDR3;

(267) an antibody that comprises the H chain of (265) and the L chain of (266);

(268) an antibody that comprises an H chain having the amino acid sequence of SEQ ID NO: 2466 as VH;

(269) an antibody that comprises an L chain having the amino acid sequence of SEQ ID NO: 2468 as VL;

(270) an antibody that comprises the H chain of (268) and the L chain of (269);

IR-054 antibody:

(271) an antibody that comprises an H chain having the amino acid sequence of SEQ ID NO: 726 as CDR1, the amino acid sequence of SEQ ID NO: 728 as CDR2, and the amino acid sequence of SEQ ID NO: 730 as CDR3;

(272) an antibody that comprises an L chain having the amino acid sequence of SEQ ID NO: 732 as CDR1, the amino acid sequence of SEQ ID NO: 734 as CDR2, and the amino acid sequence of SEQ ID NO: 736 as CDR3;

(273) an antibody that comprises the H chain of (271) and the L chain of (272);

(274) an antibody that comprises an H chain having the amino acid sequence of SEQ ID NO: 2470 as VH;

(275) an antibody that comprises an L chain having the amino acid sequence of SEQ ID NO: 2472 as VL;

(276) an antibody that comprises the H chain of (274) and the L chain of (275);

IR-055 antibody:

(277) an antibody that comprises an H chain having the amino acid sequence of SEQ ID NO: 742 as CDR1, the amino acid sequence of SEQ ID NO: 744 as CDR2, and the amino acid sequence of SEQ ID NO: 746 as CDR3;

(278) an antibody that comprises an L chain having the amino acid sequence of SEQ ID NO: 748 as CDR1, the amino acid sequence of SEQ ID NO: 750 as CDR2, and the amino acid sequence of SEQ ID NO: 752 as CDR3;

(279) an antibody that comprises the H chain of (277) and the L chain of (278);

(280) an antibody that comprises an H chain having the amino acid sequence of SEQ ID NO: 2474 as VH;

(281) an antibody that comprises an L chain having the amino acid sequence of SEQ ID NO: 2476 as VL;

(282) an antibody that comprises the H chain of (280) and the L chain of (281);

IR-056 antibody:

(283) an antibody that comprises an H chain having the amino acid sequence of SEQ ID NO: 758 as CDR1, the amino acid sequence of SEQ ID NO: 760 as CDR2, and the amino acid sequence of SEQ ID NO: 762 as CDR3;

(284) an antibody that comprises an L chain having the amino acid sequence of SEQ ID NO: 764 as CDR1, the amino acid sequence of SEQ ID NO: 766 as CDR2, and the amino acid sequence of SEQ ID NO: 768 as CDR3;

(285) an antibody that comprises the H chain of (283) and the L chain of (284);

(286) an antibody that comprises an H chain having the amino acid sequence of SEQ ID NO: 2478 as VH;

(287) an antibody that comprises an L chain having the amino acid sequence of SEQ ID NO: 2480 as VL;

(288) an antibody that comprises the H chain of (286) and the L chain of (287);

IR-057 antibody:

(289) an antibody that comprises an H chain having the amino acid sequence of SEQ ID NO: 774 as CDR1, the amino acid sequence of SEQ ID NO: 776 as CDR2, and the amino acid sequence of SEQ ID NO: 778 as CDR3;

(290) an antibody that comprises an L chain having the amino acid sequence of SEQ ID NO: 780 as CDR1, the amino acid sequence of SEQ ID NO: 782 as CDR2, and the amino acid sequence of SEQ ID NO: 784 as CDR3;

(291) an antibody that comprises the H chain of (289) and the L chain of (290);

(292) an antibody that comprises an H chain having the amino acid sequence of SEQ ID NO: 2482 as VH;

(293) an antibody that comprises an L chain having the amino acid sequence of SEQ ID NO: 2484 as VL;

(294) an antibody that comprises the H chain of (292) and the L chain of (293);

IR-058 antibody:

(295) an antibody that comprises an H chain having the amino acid sequence of SEQ ID NO: 790 as CDR1, the amino acid sequence of SEQ ID NO: 792 as CDR2, and the amino acid sequence of SEQ ID NO: 794 as CDR3;

(296) an antibody that comprises an L chain having the amino acid sequence of SEQ ID NO: 796 as CDR1, the amino acid sequence of SEQ ID NO: 798 as CDR2, and the amino acid sequence of SEQ ID NO: 800 as CDR3;

(297) an antibody that comprises the H chain of (295) and the L chain of (296);

(298) an antibody that comprises an H chain having the amino acid sequence of SEQ ID NO: 2486 as VH;

(299) an antibody that comprises an L chain having the amino acid sequence of SEQ ID NO: 2488 as VL;

(300) an antibody that comprises the H chain of (298) and the L chain of (299);

IR-059 antibody:

(301) an antibody that comprises an H chain having the amino acid sequence of SEQ ID NO: 806 as CDR1, the amino acid sequence of SEQ ID NO: 808 as CDR2, and the amino acid sequence of SEQ ID NO: 810 as CDR3;

(302) an antibody that comprises an L chain having the amino acid sequence of SEQ ID NO: 812 as CDR1, the amino acid sequence of SEQ ID NO: 814 as CDR2, and the amino acid sequence of SEQ ID NO: 816 as CDR3;

(303) an antibody that comprises the H chain of (301) and the L chain of (302);

(304) an antibody that comprises an H chain having the amino acid sequence of SEQ ID NO: 2490 as VH;

(305) an antibody that comprises an L chain having the amino acid sequence of SEQ ID NO: 2492 as VL;

(306) an antibody that comprises the H chain of (304) and the L chain of (305);

IR-060 antibody:

(307) an antibody that comprises an H chain having the amino acid sequence of SEQ ID NO: 822 as CDR1, the amino acid sequence of SEQ ID NO: 824 as CDR2, and the amino acid sequence of SEQ ID NO: 826 as CDR3;

(308) an antibody that comprises an L chain having the amino acid sequence of SEQ ID NO: 828 as CDR1, the amino acid sequence of SEQ ID NO: 830 as CDR2, and the amino acid sequence of SEQ ID NO: 832 as CDR3;

(309) an antibody that comprises the H chain of (307) and the L chain of (308);

(310) an antibody that comprises an H chain having the amino acid sequence of SEQ ID NO: 2494 as VH;

(311) an antibody that comprises an L chain having the amino acid sequence of SEQ ID NO: 2496 as VL;

(312) an antibody that comprises the H chain of (310) and the L chain of (311);

IR-061 antibody:

(313) an antibody that comprises an H chain having the amino acid sequence of SEQ ID NO: 838 as CDR1, the amino acid sequence of SEQ ID NO: 840 as CDR2, and the amino acid sequence of SEQ ID NO: 842 as CDR3;

(314) an antibody that comprises an L chain having the amino acid sequence of SEQ ID NO: 844 as CDR1, the amino acid sequence of SEQ ID NO: 846 as CDR2, and the amino acid sequence of SEQ ID NO: 848 as CDR3;

(315) an antibody that comprises the H chain of (313) and the L chain of (314);

(316) an antibody that comprises an H chain having the amino acid sequence of SEQ ID NO: 2498 as VH;

(317) an antibody that comprises an L chain having the amino acid sequence of SEQ ID NO: 2500 as VL;

(318) an antibody that comprises the H chain of (316) and the L chain of (317);

IR-062 antibody:

(319) an antibody that comprises an H chain having the amino acid sequence of SEQ ID NO: 854 as CDR1, the amino acid sequence of SEQ ID NO: 856 as CDR2, and the amino acid sequence of SEQ ID NO: 858 as CDR3;

(320) an antibody that comprises an L chain having the amino acid sequence of SEQ ID NO: 860 as CDR1, the amino acid sequence of SEQ ID NO: 862 as CDR2, and the amino acid sequence of SEQ ID NO: 864 as CDR3;

(321) an antibody that comprises the H chain of (319) and the L chain of (320);

(322) an antibody that comprises an H chain having the amino acid sequence of SEQ ID NO: 2502 as VH;

(323) an antibody that comprises an L chain having the amino acid sequence of SEQ ID NO: 2504 as VL;

(324) an antibody that comprises the H chain of (322) and the L chain of (323);

IR-063 antibody:

(325) an antibody that comprises an H chain having the amino acid sequence of SEQ ID NO: 870 as CDR1, the amino acid sequence of SEQ ID NO: 872 as CDR2, and the amino acid sequence of SEQ ID NO: 874 as CDR3;

(326) an antibody that comprises an L chain having the amino acid sequence of SEQ ID NO: 876 as CDR1, the amino acid sequence of SEQ ID NO: 878 as CDR2, and the amino acid sequence of SEQ ID NO: 880 as CDR3;

(327) an antibody that comprises the H chain of (325) and the L chain of (326);

(328) an antibody that comprises an H chain having the amino acid sequence of SEQ ID NO: 2506 as VH;

(329) an antibody that comprises an L chain having the amino acid sequence of SEQ ID NO: 2508 as VL;

(330) an antibody that comprises the H chain of (328) and the L chain of (329);

IR-064 antibody:

(331) an antibody that comprises an H chain having the amino acid sequence of SEQ ID NO: 886 as CDR1, the amino acid sequence of SEQ ID NO: 888 as CDR2, and the amino acid sequence of SEQ ID NO: 890 as CDR3;

(332) an antibody that comprises an L chain having the amino acid sequence of SEQ ID NO: 892 as CDR1, the amino acid sequence of SEQ ID NO: 894 as CDR2, and the amino acid sequence of SEQ ID NO: 896 as CDR3;

(333) an antibody that comprises the H chain of (331) and the L chain of (332);

(334) an antibody that comprises an H chain having the amino acid sequence of SEQ ID NO: 2510 as VH;

(335) an antibody that comprises an L chain having the amino acid sequence of SEQ ID NO: 2512 as VL;

(336) an antibody that comprises the H chain of (334) and the L chain of (335);

IR-065 antibody:

(337) an antibody that comprises an H chain having the amino acid sequence of SEQ ID NO: 902 as CDR1, the amino acid sequence of SEQ ID NO: 904 as CDR2, and the amino acid sequence of SEQ ID NO: 906 as CDR3;

(338) an antibody that comprises an L chain having the amino acid sequence of SEQ ID NO: 908 as CDR1, the amino acid sequence of SEQ ID NO: 910 as CDR2, and the amino acid sequence of SEQ ID NO: 912 as CDR3;

(339) an antibody that comprises the H chain of (337) and the L chain of (338);

(340) an antibody that comprises an H chain having the amino acid sequence of SEQ ID NO: 2514 as VH;

(341) an antibody that comprises an L chain having the amino acid sequence of SEQ ID NO: 2516 as VL;

(342) an antibody that comprises the H chain of (340) and the L chain of (341);

IR-066 antibody:

(343) an antibody that comprises an H chain having the amino acid sequence of SEQ ID NO: 918 as CDR1, the amino acid sequence of SEQ ID NO: 920 as CDR2, and the amino acid sequence of SEQ ID NO: 922 as CDR3;

(344) an antibody that comprises an L chain having the amino acid sequence of SEQ ID NO: 924 as CDR1, the amino acid sequence of SEQ ID NO: 926 as CDR2, and the amino acid sequence of SEQ ID NO: 928 as CDR3;

(345) an antibody that comprises the H chain of (343) and the L chain of (344);

(346) an antibody that comprises an H chain having the amino acid sequence of SEQ ID NO: 2518 as VH;

(347) an antibody that comprises an L chain having the amino acid sequence of SEQ ID NO: 2520 as VL;

(348) an antibody that comprises the H chain of (346) and the L chain of (347);

IR-067 antibody:

(349) an antibody that comprises an H chain having the amino acid sequence of SEQ ID NO: 934 as CDR1, the amino acid sequence of SEQ ID NO: 936 as CDR2, and the amino acid sequence of SEQ ID NO: 938 as CDR3;

(350) an antibody that comprises an L chain having the amino acid sequence of SEQ ID NO: 940 as CDR1, the amino acid sequence of SEQ ID NO: 942 as CDR2, and the amino acid sequence of SEQ ID NO: 944 as CDR3;

(351) an antibody that comprises the H chain of (349) and the L chain of (350);

(352) an antibody that comprises an H chain having the amino acid sequence of SEQ ID NO: 2522 as VH;

(353) an antibody that comprises an L chain having the amino acid sequence of SEQ ID NO: 2524 as VL;

(354) an antibody that comprises the H chain of (352) and the L chain of (353);

IR-068 antibody:

(355) an antibody that comprises an H chain having the amino acid sequence of SEQ ID NO: 950 as CDR1, the amino acid sequence of SEQ ID NO: 952 as CDR2, and the amino acid sequence of SEQ ID NO: 954 as CDR3;

(356) an antibody that comprises an L chain having the amino acid sequence of SEQ ID NO: 956 as CDR1, the amino acid sequence of SEQ ID NO: 958 as CDR2, and the amino acid sequence of SEQ ID NO: 960 as CDR3;

(357) an antibody that comprises the H chain of (355) and the L chain of (356);

(358) an antibody that comprises an H chain having the amino acid sequence of SEQ ID NO: 2526 as VH;

(359) an antibody that comprises an L chain having the amino acid sequence of SEQ ID NO: 2528 as VL;

(360) an antibody that comprises the H chain of (358) and the L chain of (359);

IR-069 antibody:

(361) an antibody that comprises an H chain having the amino acid sequence of SEQ ID NO: 966 as CDR1, the amino acid sequence of SEQ ID NO: 968 as CDR2, and the amino acid sequence of SEQ ID NO: 970 as CDR3;

(362) an antibody that comprises an L chain having the amino acid sequence of SEQ ID NO: 972 as CDR1, the amino acid sequence of SEQ ID NO: 974 as CDR2, and the amino acid sequence of SEQ ID NO: 976 as CDR3;

(363) an antibody that comprises the H chain of (361) and the L chain of (362);

(364) an antibody that comprises an H chain having the amino acid sequence of SEQ ID NO: 2530 as VH;

(365) an antibody that comprises an L chain having the amino acid sequence of SEQ ID NO: 2532 as VL;

(366) an antibody that comprises the H chain of (364) and the L chain of (365);

IR-070 antibody:

(367) an antibody that comprises an H chain having the amino acid sequence of SEQ ID NO: 982 as CDR1, the amino acid sequence of SEQ ID NO: 984 as CDR2, and the amino acid sequence of SEQ ID NO: 986 as CDR3;

(368) an antibody that comprises an L chain having the amino acid sequence of SEQ ID NO: 988 as CDR1, the amino acid sequence of SEQ ID NO: 990 as CDR2, and the amino acid sequence of SEQ ID NO: 992 as CDR3;

(369) an antibody that comprises the H chain of (367) and the L chain of (368);

(370) an antibody that comprises an H chain having the amino acid sequence of SEQ ID NO: 2534 as VH;

(371) an antibody that comprises an L chain having the amino acid sequence of SEQ ID NO: 2536 as VL;

(372) an antibody that comprises the H chain of (370) and the L chain of (371);

IR-071 antibody:

(373) an antibody that comprises an H chain having the amino acid sequence of SEQ ID NO: 998 as CDR1, the amino acid sequence of SEQ ID NO: 1000 as CDR2, and the amino acid sequence of SEQ ID NO: 1002 as CDR3;

(374) an antibody that comprises an L chain having the amino acid sequence of SEQ ID NO: 1004 as CDR1, the amino acid sequence of SEQ ID NO: 1006 as CDR2, and the amino acid sequence of SEQ ID NO: 1008 as CDR3;

(375) an antibody that comprises the H chain of (373) and the L chain of (374);

(376) an antibody that comprises an H chain having the amino acid sequence of SEQ ID NO: 2538 as VH;

(377) an antibody that comprises an L chain having the amino acid sequence of SEQ ID NO: 2540 as VL;

(378) an antibody that comprises the H chain of (376) and the L chain of (377);

IR-072 antibody:

(379) an antibody that comprises an H chain having the amino acid sequence of SEQ ID NO: 1014 as CDR1, the amino acid sequence of SEQ ID NO: 1016 as CDR2, and the amino acid sequence of SEQ ID NO: 1018 as CDR3;

(380) an antibody that comprises an L chain having the amino acid sequence of SEQ ID NO: 1020 as CDR1, the amino acid sequence of SEQ ID NO: 1022 as CDR2, and the amino acid sequence of SEQ ID NO: 1024 as CDR3;

(381) an antibody that comprises the H chain of (379) and the L chain of (380);

(382) an antibody that comprises an H chain having the amino acid sequence of SEQ ID NO: 2542 as VH;

(383) an antibody that comprises an L chain having the amino acid sequence of SEQ ID NO: 2544 as VL;

(384) an antibody that comprises the H chain of (382) and the L chain of (383);

IR-073 antibody:

(385) an antibody that comprises an H chain having the amino acid sequence of SEQ ID NO: 1030 as CDR1, the amino acid sequence of SEQ ID NO: 1032 as CDR2, and the amino acid sequence of SEQ ID NO: 1034 as CDR3;

(386) an antibody that comprises an L chain having the amino acid sequence of SEQ ID NO: 1036 as CDR1, the amino acid sequence of SEQ ID NO: 1038 as CDR2, and the amino acid sequence of SEQ ID NO: 1040 as CDR3;

(387) an antibody that comprises the H chain of (385) and the L chain of (386);

(388) an antibody that comprises an H chain having the amino acid sequence of SEQ ID NO: 2546 as VH;

(389) an antibody that comprises an L chain having the amino acid sequence of SEQ ID NO: 2548 as VL;

(390) an antibody that comprises the H chain of (388) and the L chain of (389);

IR-074 antibody:

(391) an antibody that comprises an H chain having the amino acid sequence of SEQ ID NO: 1046 as CDR1, the amino acid sequence of SEQ ID NO: 1048 as CDR2, and the amino acid sequence of SEQ ID NO: 1050 as CDR3;

(392) an antibody that comprises an L chain having the amino acid sequence of SEQ ID NO: 1052 as CDR1, the amino acid sequence of SEQ ID NO: 1054 as CDR2, and the amino acid sequence of SEQ ID NO: 1056 as CDR3;

(393) an antibody that comprises the H chain of (391) and the L chain of (392);

(394) an antibody that comprises an H chain having the amino acid sequence of SEQ ID NO: 2550 as VH;

(395) an antibody that comprises an L chain having the amino acid sequence of SEQ ID NO: 2552 as VL;

(396) an antibody that comprises the H chain of (394) and the L chain of (395);

IR-075 antibody:

(397) an antibody that comprises an H chain having the amino acid sequence of SEQ ID NO: 1062 as CDR1, the amino acid sequence of SEQ ID NO: 1064 as CDR2, and the amino acid sequence of SEQ ID NO: 1066 as CDR3;

(398) an antibody that comprises an L chain having the amino acid sequence of SEQ ID NO: 1068 as CDR1, the amino acid sequence of SEQ ID NO: 1070 as CDR2, and the amino acid sequence of SEQ ID NO: 1072 as CDR3;

(399) an antibody that comprises the H chain of (397) and the L chain of (398);

(400) an antibody that comprises an H chain having the amino acid sequence of SEQ ID NO: 2554 as VH;

(401) an antibody that comprises an L chain having the amino acid sequence of SEQ ID NO: 2556 as VL;

(402) an antibody that comprises the H chain of (400) and the L chain of (401);

IR-076 antibody:

(403) an antibody that comprises an H chain having the amino acid sequence of SEQ ID NO: 1078 as CDR1, the amino acid sequence of SEQ ID NO: 1080 as CDR2, and the amino acid sequence of SEQ ID NO: 1082 as CDR3;

(404) an antibody that comprises an L chain having the amino acid sequence of SEQ ID NO: 1084 as CDR1, the amino acid sequence of SEQ ID NO: 1086 as CDR2, and the amino acid sequence of SEQ ID NO: 1088 as CDR3;

(405) an antibody that comprises the H chain of (403) and the L chain of (404);

(406) an antibody that comprises an H chain having the amino acid sequence of SEQ ID NO: 2558 as VH;

(407) an antibody that comprises an L chain having the amino acid sequence of SEQ ID NO: 2560 as VL;

(408) an antibody that comprises the H chain of (406) and the L chain of (407);

IR-077 antibody:

(409) an antibody that comprises an H chain having the amino acid sequence of SEQ ID NO: 1094 as CDR1, the amino acid sequence of SEQ ID NO: 1096 as CDR2, and the amino acid sequence of SEQ ID NO: 1098 as CDR3;

(410) an antibody that comprises an L chain having the amino acid sequence of SEQ ID NO: 1100 as CDR1, the amino acid sequence of SEQ ID NO: 1102 as CDR2, and the amino acid sequence of SEQ ID NO: 1104 as CDR3;

(411) an antibody that comprises the H chain of (409) and the L chain of (410);

(412) an antibody that comprises an H chain having the amino acid sequence of SEQ ID NO: 2562 as VH;

(413) an antibody that comprises an L chain having the amino acid sequence of SEQ ID NO: 2564 as VL;

(414) an antibody that comprises the H chain of (412) and the L chain of (413);

IR-078 antibody:

(415) an antibody that comprises an H chain having the amino acid sequence of SEQ ID NO: 1110 as CDR1, the amino acid sequence of SEQ ID NO: 1112 as CDR2, and the amino acid sequence of SEQ ID NO: 1114 as CDR3;

(416) an antibody that comprises an L chain having the amino acid sequence of SEQ ID NO: 1116 as CDR1, the amino acid sequence of SEQ ID NO: 1118 as CDR2, and the amino acid sequence of SEQ ID NO: 1120 as CDR3;

(417) an antibody that comprises the H chain of (415) and the L chain of (416);

(418) an antibody that comprises an H chain having the amino acid sequence of SEQ ID NO: 2566 as VH;

(419) an antibody that comprises an L chain having the amino acid sequence of SEQ ID NO: 2568 as VL;

(420) an antibody that comprises the H chain of (418) and the L chain of (419);

IR-079 antibody:

(421) an antibody that comprises an H chain having the amino acid sequence of SEQ ID NO: 1126 as CDR1, the amino acid sequence of SEQ ID NO: 1128 as CDR2, and the amino acid sequence of SEQ ID NO: 1130 as CDR3;

(422) an antibody that comprises an L chain having the amino acid sequence of SEQ ID NO: 1132 as CDR1, the amino acid sequence of SEQ ID NO: 1134 as CDR2, and the amino acid sequence of SEQ ID NO: 1136 as CDR3;

(423) an antibody that comprises the H chain of (421) and the L chain of (422);

(424) an antibody that comprises an H chain having the amino acid sequence of SEQ ID NO: 2570 as VH;

(425) an antibody that comprises an L chain having the amino acid sequence of SEQ ID NO: 2572 as VL;

(426) an antibody that comprises the H chain of (424) and the L chain of (425);

IR-080 antibody:

(427) an antibody that comprises an H chain having the amino acid sequence of SEQ ID NO: 1142 as CDR1, the amino acid sequence of SEQ ID NO: 1144 as CDR2, and the amino acid sequence of SEQ ID NO: 1146 as CDR3;

(428) an antibody that comprises an L chain having the amino acid sequence of SEQ ID NO: 1148 as CDR1, the amino acid sequence of SEQ ID NO: 1150 as CDR2, and the amino acid sequence of SEQ ID NO: 1152 as CDR3;

(429) an antibody that comprises the H chain of (427) and the L chain of (428);

(430) an antibody that comprises an H chain having the amino acid sequence of SEQ ID NO: 2574 as VH;

(431) an antibody that comprises an L chain having the amino acid sequence of SEQ ID NO: 2576 as VL;

(432) an antibody that comprises the H chain of (430) and the L chain of (431);

IR-081 antibody:

(433) an antibody that comprises an H chain having the amino acid sequence of SEQ ID NO: 1158 as CDR1, the amino acid sequence of SEQ ID NO: 1160 as CDR2, and the amino acid sequence of SEQ ID NO: 1162 as CDR3;

(434) an antibody that comprises an L chain having the amino acid sequence of SEQ ID NO: 1164 as CDR1, the amino acid sequence of SEQ ID NO: 1166 as CDR2, and the amino acid sequence of SEQ ID NO: 1168 as CDR3;

(435) an antibody that comprises the H chain of (433) and the L chain of (434);

(436) an antibody that comprises an H chain having the amino acid sequence of SEQ ID NO: 2578 as VH;

(437) an antibody that comprises an L chain having the amino acid sequence of SEQ ID NO: 2580 as VL;

(438) an antibody that comprises the H chain of (436) and the L chain of (437);

IR-082 antibody:

(439) an antibody that comprises an H chain having the amino acid sequence of SEQ ID NO: 1174 as CDR1, the amino acid sequence of SEQ ID NO: 1176 as CDR2, and the amino acid sequence of SEQ ID NO: 1178 as CDR3;

(440) an antibody that comprises an L chain having the amino acid sequence of SEQ ID NO: 1180 as CDR1, the amino acid sequence of SEQ ID NO: 1182 as CDR2, and the amino acid sequence of SEQ ID NO: 1184 as CDR3;

(441) an antibody that comprises the H chain of (439) and the L chain of (440);

(442) an antibody that comprises an H chain having the amino acid sequence of SEQ ID NO: 2582 as VH;

(443) an antibody that comprises an L chain having the amino acid sequence of SEQ ID NO: 2584 as VL;

(444) an antibody that comprises the H chain of (442) and the L chain of (443);

IR-083 antibody:

(445) an antibody that comprises an H chain having the amino acid sequence of SEQ ID NO: 1190 as CDR1, the amino acid sequence of SEQ ID NO: 1192 as CDR2, and the amino acid sequence of SEQ ID NO: 1194 as CDR3;

(446) an antibody that comprises an L chain having the amino acid sequence of SEQ ID NO: 1196 as CDR1, the amino acid sequence of SEQ ID NO: 1198 as CDR2, and the amino acid sequence of SEQ ID NO: 1200 as CDR3;

(447) an antibody that comprises the H chain of (445) and the L chain of (446);

(448) an antibody that comprises an H chain having the amino acid sequence of SEQ ID NO: 2586 as VH;

(449) an antibody that comprises an L chain having the amino acid sequence of SEQ ID NO: 2588 as VL;

(450) an antibody that comprises the H chain of (448) and the L chain of (449);

IR-084 antibody:

(451) an antibody that comprises an H chain having the amino acid sequence of SEQ ID NO: 1206 as CDR1, the amino acid sequence of SEQ ID NO: 1208 as CDR2, and the amino acid sequence of SEQ ID NO: 1210 as CDR3;

(452) an antibody that comprises an L chain having the amino acid sequence of SEQ ID NO: 1212 as CDR1, the amino acid sequence of SEQ ID NO: 1214 as CDR2, and the amino acid sequence of SEQ ID NO: 1216 as CDR3;

(453) an antibody that comprises the H chain of (451) and the L chain of (452);

(454) an antibody that comprises an H chain having the amino acid sequence of SEQ ID NO: 2590 as VH;

(455) an antibody that comprises an L chain having the amino acid sequence of SEQ ID NO: 2592 as VL;

(456) an antibody that comprises the H chain of (454) and the L chain of (455);

IR-085 antibody:

(457) an antibody that comprises an H chain having the amino acid sequence of SEQ ID NO: 1222 as CDR1, the amino acid sequence of SEQ ID NO: 1224 as CDR2, and the amino acid sequence of SEQ ID NO: 1226 as CDR3;

(458) an antibody that comprises an L chain having the amino acid sequence of SEQ ID NO: 1228 as CDR1, the amino acid sequence of SEQ ID NO: 1230 as CDR2, and the amino acid sequence of SEQ ID NO: 1232 as CDR3;

(459) an antibody that comprises the H chain of (457) and the L chain of (458);

(460) an antibody that comprises an H chain having the amino acid sequence of SEQ ID NO: 2594 as VH;

(461) an antibody that comprises an L chain having the amino acid sequence of SEQ ID NO: 2596 as VL;

(462) an antibody that comprises the H chain of (460) and the L chain of (461);

IR-086 antibody:

(463) an antibody that comprises an H chain having the amino acid sequence of SEQ ID NO: 1238 as CDR1, the amino acid sequence of SEQ ID NO: 1240 as CDR2, and the amino acid sequence of SEQ ID NO: 1242 as CDR3;

(464) an antibody that comprises an L chain having the amino acid sequence of SEQ ID NO: 1244 as CDR1, the amino acid sequence of SEQ ID NO: 1246 as CDR2, and the amino acid sequence of SEQ ID NO: 1248 as CDR3;

(465) an antibody that comprises the H chain of (463) and the L chain of (464);

(466) an antibody that comprises an H chain having the amino acid sequence of SEQ ID NO: 2598 as VH;

(467) an antibody that comprises an L chain having the amino acid sequence of SEQ ID NO: 2600 as VL;

(468) an antibody that comprises the H chain of (466) and the L chain of (467);

IR-087 antibody:

(469) an antibody that comprises an H chain having the amino acid sequence of SEQ ID NO: 1254 as CDR1, the amino acid sequence of SEQ ID NO: 1256 as CDR2, and the amino acid sequence of SEQ ID NO: 1258 as CDR3;

(470) an antibody that comprises an L chain having the amino acid sequence of SEQ ID NO: 1260 as CDR1, the amino acid sequence of SEQ ID NO: 1262 as CDR2, and the amino acid sequence of SEQ ID NO: 1264 as CDR3;

(471) an antibody that comprises the H chain of (469) and the L chain of (470);

(472) an antibody that comprises an H chain having the amino acid sequence of SEQ ID NO: 2602 as VH;

(473) an antibody that comprises an L chain having the amino acid sequence of SEQ ID NO: 2604 as VL;

(474) an antibody that comprises the H chain of (472) and the L chain of (473);

IR-088 antibody:

(475) an antibody that comprises an H chain having the amino acid sequence of SEQ ID NO: 1270 as CDR1, the amino acid sequence of SEQ ID NO: 1272 as CDR2, and the amino acid sequence of SEQ ID NO: 1274 as CDR3;

(476) an antibody that comprises an L chain having the amino acid sequence of SEQ ID NO: 1276 as CDR1, the amino acid sequence of SEQ ID NO: 1278 as CDR2, and the amino acid sequence of SEQ ID NO: 1280 as CDR3;

(477) an antibody that comprises the H chain of (475) and the L chain of (476);

(478) an antibody that comprises an H chain having the amino acid sequence of SEQ ID NO: 2606 as VH;

(479) an antibody that comprises an L chain having the amino acid sequence of SEQ ID NO: 2608 as VL;

(480) an antibody that comprises the H chain of (478) and the L chain of (479);

IR-089 antibody:

(481) an antibody that comprises an H chain having the amino acid sequence of SEQ ID NO: 1286 as CDR1, the amino acid sequence of SEQ ID NO: 1288 as CDR2, and the amino acid sequence of SEQ ID NO: 1290 as CDR3;

(482) an antibody that comprises an L chain having the amino acid sequence of SEQ ID NO: 1292 as CDR1, the amino acid sequence of SEQ ID NO: 1294 as CDR2, and the amino acid sequence of SEQ ID NO: 1296 as CDR3;

(483) an antibody that comprises the H chain of (481) and the L chain of (482);

(484) an antibody that comprises an H chain having the amino acid sequence of SEQ ID NO: 2610 as VH;

(485) an antibody that comprises an L chain having the amino acid sequence of SEQ ID NO: 2612 as VL;

(486) an antibody that comprises the H chain of (484) and the L chain of (485);

IR-090 antibody:

(487) an antibody that comprises an H chain having the amino acid sequence of SEQ ID NO: 1302 as CDR1, the amino acid sequence of SEQ ID NO: 1304 as CDR2, and the amino acid sequence of SEQ ID NO: 1306 as CDR3;

(488) an antibody that comprises an L chain having the amino acid sequence of SEQ ID NO: 1308 as CDR1, the amino acid sequence of SEQ ID NO: 1310 as CDR2, and the amino acid sequence of SEQ ID NO: 1312 as CDR3;

(489) an antibody that comprises the H chain of (487) and the L chain of (488);

(490) an antibody that comprises an H chain having the amino acid sequence of SEQ ID NO: 2614 as VH;

(491) an antibody that comprises an L chain having the amino acid sequence of SEQ ID NO: 2616 as VL;

(492) an antibody that comprises the H chain of (490) and the L chain of (491);

IR-092 antibody:

(493) an antibody that comprises an H chain having the amino acid sequence of SEQ ID NO: 1318 as CDR1, the amino acid sequence of SEQ ID NO: 1320 as CDR2, and the amino acid sequence of SEQ ID NO: 1322 as CDR3;

(494) an antibody that comprises an L chain having the amino acid sequence of SEQ ID NO: 1324 as CDR1, the amino acid sequence of SEQ ID NO: 1326 as CDR2, and the amino acid sequence of SEQ ID NO: 1328 as CDR3;

(495) an antibody that comprises the H chain of (493) and the L chain of (494);

(496) an antibody that comprises an H chain having the amino acid sequence of SEQ ID NO: 2618 as VH;

(497) an antibody that comprises an L chain having the amino acid sequence of SEQ ID NO: 2620 as VL;

(498) an antibody that comprises the H chain of (496) and the L chain of (497);

IR-093 antibody:

(499) an antibody that comprises an H chain having the amino acid sequence of SEQ ID NO: 1334 as CDR1, the amino acid sequence of SEQ ID NO: 1336 as CDR2, and the amino acid sequence of SEQ ID NO: 1338 as CDR3;

(500) an antibody that comprises an L chain having the amino acid sequence of SEQ ID NO: 1340 as CDR1, the amino acid sequence of SEQ ID NO: 1342 as CDR2, and the amino acid sequence of SEQ ID NO: 1344 as CDR3;

(501) an antibody that comprises the H chain of (499) and the L chain of (500);

(502) an antibody that comprises an H chain having the amino acid sequence of SEQ ID NO: 2622 as VH;

(503) an antibody that comprises an L chain having the amino acid sequence of SEQ ID NO: 2624 as VL;

(504) an antibody that comprises the H chain of (502) and the L chain of (503);

IR-094 antibody:

(505) an antibody that comprises an H chain having the amino acid sequence of SEQ ID NO: 1350 as CDR1, the amino acid sequence of SEQ ID NO: 1352 as CDR2, and the amino acid sequence of SEQ ID NO: 1354 as CDR3;

(506) an antibody that comprises an L chain having the amino acid sequence of SEQ ID NO: 1356 as CDR1, the amino acid sequence of SEQ ID NO: 1358 as CDR2, and the amino acid sequence of SEQ ID NO: 1360 as CDR3;

(507) an antibody that comprises the H chain of (505) and the L chain of (506);

(508) an antibody that comprises an H chain having the amino acid sequence of SEQ ID NO: 2626 as VH;

(509) an antibody that comprises an L chain having the amino acid sequence of SEQ ID NO: 2628 as VL;

(510) an antibody that comprises the H chain of (508) and the L chain of (509);

IR-095 antibody:

(511) an antibody that comprises an H chain having the amino acid sequence of SEQ ID NO: 1366 as CDR1, the amino acid sequence of SEQ ID NO: 1368 as CDR2, and the amino acid sequence of SEQ ID NO: 1370 as CDR3;

(512) an antibody that comprises an L chain having the amino acid sequence of SEQ ID NO: 1372 as CDR1, the amino acid sequence of SEQ ID NO: 1374 as CDR2, and the amino acid sequence of SEQ ID NO: 1376 as CDR3;

(513) an antibody that comprises the H chain of (511) and the L chain of (512);

(514) an antibody that comprises an H chain having the amino acid sequence of SEQ ID NO: 2630 as VH;

(515) an antibody that comprises an L chain having the amino acid sequence of SEQ ID NO: 2632 as VL;

(516) an antibody that comprises the H chain of (514) and the L chain of (515);

IR-097 antibody:

(517) an antibody that comprises an H chain having the amino acid sequence of SEQ ID NO: 1382 as CDR1, the amino acid sequence of SEQ ID NO: 1384 as CDR2, and the amino acid sequence of SEQ ID NO: 1386 as CDR3;

(518) an antibody that comprises an L chain having the amino acid sequence of SEQ ID NO: 1388 as CDR1, the amino acid sequence of SEQ ID NO: 1390 as CDR2, and the amino acid sequence of SEQ ID NO: 1392 as CDR3;

(519) an antibody that comprises the H chain of (517) and the L chain of (518);

(520) an antibody that comprises an H chain having the amino acid sequence of SEQ ID NO: 2634 as VH;

(521) an antibody that comprises an L chain having the amino acid sequence of SEQ ID NO: 2636 as VL;

(522) an antibody that comprises the H chain of (520) and the L chain of (521);

IR-098 antibody:

(523) an antibody that comprises an H chain having the amino acid sequence of SEQ ID NO: 1398 as CDR1, the amino acid sequence of SEQ ID NO: 1400 as CDR2, and the amino acid sequence of SEQ ID NO: 1402 as CDR3;

(524) an antibody that comprises an L chain having the amino acid sequence of SEQ ID NO: 1404 as CDR1, the amino acid sequence of SEQ ID NO: 1406 as CDR2, and the amino acid sequence of SEQ ID NO: 1408 as CDR3;

(525) an antibody that comprises the H chain of (523) and the L chain of (524);

(526) an antibody that comprises an H chain having the amino acid sequence of SEQ ID NO: 2638 as VH;

(527) an antibody that comprises an L chain having the amino acid sequence of SEQ ID NO: 2640 as VL;

(528) an antibody that comprises the H chain of (526) and the L chain of (527);

IR-100 antibody:

(529) an antibody that comprises an H chain having the amino acid sequence of SEQ ID NO: 1414 as CDR1, the amino acid sequence of SEQ ID NO: 1416 as CDR2, and the amino acid sequence of SEQ ID NO: 1418 as CDR3;

(530) an antibody that comprises an L chain having the amino acid sequence of SEQ ID NO: 1420 as CDR1, the amino acid sequence of SEQ ID NO: 1422 as CDR2, and the amino acid sequence of SEQ ID NO: 1424 as CDR3;

(531) an antibody that comprises the H chain of (529) and the L chain of (530);

(532) an antibody that comprises an H chain having the amino acid sequence of SEQ ID NO: 2642 as VH;

(533) an antibody that comprises an L chain having the amino acid sequence of SEQ ID NO: 2644 as VL;

(534) an antibody that comprises the H chain of (532) and the L chain of (533);

IR-101 antibody:

(535) an antibody that comprises an H chain having the amino acid sequence of SEQ ID NO: 1430 as CDR1, the amino acid sequence of SEQ ID NO: 1432 as CDR2, and the amino acid sequence of SEQ ID NO: 1434 as CDR3;

(536) an antibody that comprises an L chain having the amino acid sequence of SEQ ID NO: 1436 as CDR1, the amino acid sequence of SEQ ID NO: 1438 as CDR2, and the amino acid sequence of SEQ ID NO: 1440 as CDR3;

(537) an antibody that comprises the H chain of (535) and the L chain of (536);

(538) an antibody that comprises an H chain having the amino acid sequence of SEQ ID NO: 2646 as VH;

(539) an antibody that comprises an L chain having the amino acid sequence of SEQ ID NO: 2648 as VL;

(540) an antibody that comprises the H chain of (538) and the L chain of (539);

IR-102 antibody:

(541) an antibody that comprises an H chain having the amino acid sequence of SEQ ID NO: 1446 as CDR1, the amino acid sequence of SEQ ID NO: 1448 as CDR2, and the amino acid sequence of SEQ ID NO: 1450 as CDR3;

(542) an antibody that comprises an L chain having the amino acid sequence of SEQ ID NO: 1452 as CDR1, the amino acid sequence of SEQ ID NO: 1454 as CDR2, and the amino acid sequence of SEQ ID NO: 1456 as CDR3;

(543) an antibody that comprises the H chain of (541) and the L chain of (542);

(544) an antibody that comprises an H chain having the amino acid sequence of SEQ ID NO: 2650 as VH;

(545) an antibody that comprises an L chain having the amino acid sequence of SEQ ID NO: 2652 as VL;

(546) an antibody that comprises the H chain of (544) and the L chain of (545);

IR-104 antibody:

(547) an antibody that comprises an H chain having the amino acid sequence of SEQ ID NO: 1462 as CDR1, the amino acid sequence of SEQ ID NO: 1464 as CDR2, and the amino acid sequence of SEQ ID NO: 1466 as CDR3;

(548) an antibody that comprises an L chain having the amino acid sequence of SEQ ID NO: 1468 as CDR1, the amino acid sequence of SEQ ID NO: 1470 as CDR2, and the amino acid sequence of SEQ ID NO: 1472 as CDR3;

(549) an antibody that comprises the H chain of (547) and the L chain of (548);

(550) an antibody that comprises an H chain having the amino acid sequence of SEQ ID NO: 2654 as VH;

(551) an antibody that comprises an L chain having the amino acid sequence of SEQ ID NO: 2656 as VL;

(552) an antibody that comprises the H chain of (550) and the L chain of (551);

IR-105 antibody:

(553) an antibody that comprises an H chain having the amino acid sequence of SEQ ID NO: 1478 as CDR1, the amino acid sequence of SEQ ID NO: 1480 as CDR2, and the amino acid sequence of SEQ ID NO: 1482 as CDR3;

(554) an antibody that comprises an L chain having the amino acid sequence of SEQ ID NO: 1484 as CDR1, the amino acid sequence of SEQ ID NO: 1486 as CDR2, and the amino acid sequence of SEQ ID NO: 1488 as CDR3;

(555) an antibody that comprises the H chain of (553) and the L chain of (554);

(556) an antibody that comprises an H chain having the amino acid sequence of SEQ ID NO: 2658 as VH;

(557) an antibody that comprises an L chain having the amino acid sequence of SEQ ID NO: 2660 as VL;

(558) an antibody that comprises the H chain of (556) and the L chain of (557);

IR-106 antibody:

(559) an antibody that comprises an H chain having the amino acid sequence of SEQ ID NO: 1494 as CDR1, the amino acid sequence of SEQ ID NO: 1496 as CDR2, and the amino acid sequence of SEQ ID NO: 1498 as CDR3;

(560) an antibody that comprises an L chain having the amino acid sequence of SEQ ID NO: 1500 as CDR1, the amino acid sequence of SEQ ID NO: 1502 as CDR2, and the amino acid sequence of SEQ ID NO: 1504 as CDR3;

(561) an antibody that comprises the H chain of (559) and the L chain of (560);

(562) an antibody that comprises an H chain having the amino acid sequence of SEQ ID NO: 2662 as VH;

(563) an antibody that comprises an L chain having the amino acid sequence of SEQ ID NO: 2664 as VL;

(564) an antibody that comprises the H chain of (562) and the L chain of (563);

IR-107 antibody:

(565) an antibody that comprises an H chain having the amino acid sequence of SEQ ID NO: 1510 as CDR1, the amino acid sequence of SEQ ID NO: 1512 as CDR2, and the amino acid sequence of SEQ ID NO: 1514 as CDR3;

(566) an antibody that comprises an L chain having the amino acid sequence of SEQ ID NO: 1516 as CDR1, the amino acid sequence of SEQ ID NO: 1518 as CDR2, and the amino acid sequence of SEQ ID NO: 1520 as CDR3;

(567) an antibody that comprises the H chain of (565) and the L chain of (566);

(568) an antibody that comprises an H chain having the amino acid sequence of SEQ ID NO: 2666 as VH;

(569) an antibody that comprises an L chain having the amino acid sequence of SEQ ID NO: 2668 as VL;

(570) an antibody that comprises the H chain of (568) and the L chain of (569);

IR-108 antibody:

(571) an antibody that comprises an H chain having the amino acid sequence of SEQ ID NO: 1526 as CDR1, the amino acid sequence of SEQ ID NO: 1528 as CDR2, and the amino acid sequence of SEQ ID NO: 1530 as CDR3;

(572) an antibody that comprises an L chain having the amino acid sequence of SEQ ID NO: 1532 as CDR1, the amino acid sequence of SEQ ID NO: 1534 as CDR2, and the amino acid sequence of SEQ ID NO: 1536 as CDR3;

(573) an antibody that comprises the H chain of (571) and the L chain of (572);

(574) an antibody that comprises an H chain having the amino acid sequence of SEQ ID NO: 2670 as VH;

(575) an antibody that comprises an L chain having the amino acid sequence of SEQ ID NO: 2672 as VL;

(576) an antibody that comprises the H chain of (574) and the L chain of (575);

IR-109 antibody:

(577) an antibody that comprises an H chain having the amino acid sequence of SEQ ID NO: 1542 as CDR1, the amino acid sequence of SEQ ID NO: 1544 as CDR2, and the amino acid sequence of SEQ ID NO: 1546 as CDR3;

(578) an antibody that comprises an L chain having the amino acid sequence of SEQ ID NO: 1548 as CDR1, the amino acid sequence of SEQ ID NO: 1550 as CDR2, and the amino acid sequence of SEQ ID NO: 1552 as CDR3;

(579) an antibody that comprises the H chain of (577) and the L chain of (578);

(580) an antibody that comprises an H chain having the amino acid sequence of SEQ ID NO: 2674 as VH;

(581) an antibody that comprises an L chain having the amino acid sequence of SEQ ID NO: 2676 as VL;

(582) an antibody that comprises the H chain of (580) and the L chain of (581);

IR-110 antibody:

(583) an antibody that comprises an H chain having the amino acid sequence of SEQ ID NO: 1558 as CDR1, the amino acid sequence of SEQ ID NO: 1560 as CDR2, and the amino acid sequence of SEQ ID NO: 1562 as CDR3;

(584) an antibody that comprises an L chain having the amino acid sequence of SEQ ID NO: 1564 as CDR1, the amino acid sequence of SEQ ID NO: 1566 as CDR2, and the amino acid sequence of SEQ ID NO: 1568 as CDR3;

(585) an antibody that comprises the H chain of (583) and the L chain of (584);

(586) an antibody that comprises an H chain having the amino acid sequence of SEQ ID NO: 2678 as VH;

(587) an antibody that comprises an L chain having the amino acid sequence of SEQ ID NO: 2680 as VL;

(588) an antibody that comprises the H chain of (586) and the L chain of (587);

IR-112 antibody:

(589) an antibody that comprises an H chain having the amino acid sequence of SEQ ID NO: 1574 as CDR1, the amino acid sequence of SEQ ID NO: 1576 as CDR2, and the amino acid sequence of SEQ ID NO: 1578 as CDR3;

(590) an antibody that comprises an L chain having the amino acid sequence of SEQ ID NO: 1580 as CDR1, the amino acid sequence of SEQ ID NO: 1582 as CDR2, and the amino acid sequence of SEQ ID NO: 1584 as CDR3;

(591) an antibody that comprises the H chain of (589) and the L chain of (590);

(592) an antibody that comprises an H chain having the amino acid sequence of SEQ ID NO: 2682 as VH;

(593) an antibody that comprises an L chain having the amino acid sequence of SEQ ID NO: 2684 as VL;

(594) an antibody that comprises the H chain of (592) and the L chain of (593);

IR-114 antibody:

(595) an antibody that comprises an H chain having the amino acid sequence of SEQ ID NO: 1590 as CDR1, the amino acid sequence of SEQ ID NO: 1592 as CDR2, and the amino acid sequence of SEQ ID NO: 1594 as CDR3;

(596) an antibody that comprises an L chain having the amino acid sequence of SEQ ID NO: 1596 as CDR1, the amino acid sequence of SEQ ID NO: 1598 as CDR2, and the amino acid sequence of SEQ ID NO: 1600 as CDR3;

(597) an antibody that comprises the H chain of (595) and the L chain of (596);

(598) an antibody that comprises an H chain having the amino acid sequence of SEQ ID NO: 2686 as VH;

(599) an antibody that comprises an L chain having the amino acid sequence of SEQ ID NO: 2688 as VL;

(600) an antibody that comprises the H chain of (598) and the L chain of (599);

IR-115 antibody:

(601) an antibody that comprises an H chain having the amino acid sequence of SEQ ID NO: 1606 as CDR1, the amino acid sequence of SEQ ID NO: 1608 as CDR2, and the amino acid sequence of SEQ ID NO: 1610 as CDR3;

(602) an antibody that comprises an L chain having the amino acid sequence of SEQ ID NO: 1612 as CDR1, the amino acid sequence of SEQ ID NO: 1614 as CDR2, and the amino acid sequence of SEQ ID NO: 1616 as CDR3;

(603) an antibody that comprises the H chain of (601) and the L chain of (602);

(604) an antibody that comprises an H chain having the amino acid sequence of SEQ ID NO: 2690 as VH;

(605) an antibody that comprises an L chain having the amino acid sequence of SEQ ID NO: 2692 as VL;

(606) an antibody that comprises the H chain of (604) and the L chain of (605);

IR-116 antibody:

(607) an antibody that comprises an H chain having the amino acid sequence of SEQ ID NO: 1622 as CDR1, the amino acid sequence of SEQ ID NO: 1624 as CDR2, and the amino acid sequence of SEQ ID NO: 1626 as CDR3;

(608) an antibody that comprises an L chain having the amino acid sequence of SEQ ID NO: 1628 as CDR1, the amino acid sequence of SEQ ID NO: 1630 as CDR2, and the amino acid sequence of SEQ ID NO: 1632 as CDR3;

(609) an antibody that comprises the H chain of (607) and the L chain of (608);

(610) an antibody that comprises an H chain having the amino acid sequence of SEQ ID NO: 2694 as VH;

(611) an antibody that comprises an L chain having the amino acid sequence of SEQ ID NO: 2696 as VL;

(612) an antibody that comprises the H chain of (610) and the L chain of (611);

IR-117 antibody:

(613) an antibody that comprises an H chain having the amino acid sequence of SEQ ID NO: 1638 as CDR1, the amino acid sequence of SEQ ID NO: 1640 as CDR2, and the amino acid sequence of SEQ ID NO: 1642 as CDR3;

(614) an antibody that comprises an L chain having the amino acid sequence of SEQ ID NO: 1644 as CDR1, the amino acid sequence of SEQ ID NO: 1646 as CDR2, and the amino acid sequence of SEQ ID NO: 1648 as CDR3;

(615) an antibody that comprises the H chain of (613) and the L chain of (614);

(616) an antibody that comprises an H chain having the amino acid sequence of SEQ ID NO: 2698 as VH;

(617) an antibody that comprises an L chain having the amino acid sequence of SEQ ID NO: 2700 as VL;

(618) an antibody that comprises the H chain of (616) and the L chain of (617);

IR-118 antibody:

(619) an antibody that comprises an H chain having the amino acid sequence of SEQ ID NO: 1654 as CDR1, the amino acid sequence of SEQ ID NO: 1656 as CDR2, and the amino acid sequence of SEQ ID NO: 1658 as CDR3;

(620) an antibody that comprises an L chain having the amino acid sequence of SEQ ID NO: 1660 as CDR1, the amino acid sequence of SEQ ID NO: 1662 as CDR2, and the amino acid sequence of SEQ ID NO: 1664 as CDR3;

(621) an antibody that comprises the H chain of (619) and the L chain of (620);

(622) an antibody that comprises an H chain having the amino acid sequence of SEQ ID NO: 2702 as VH;

(623) an antibody that comprises an L chain having the amino acid sequence of SEQ ID NO: 2704 as VL;

(624) an antibody that comprises the H chain of (622) and the L chain of (623);

IR-119 antibody:

(625) an antibody that comprises an H chain having the amino acid sequence of SEQ ID NO: 1670 as CDR1, the amino acid sequence of SEQ ID NO: 1672 as CDR2, and the amino acid sequence of SEQ ID NO: 1674 as CDR3;

(626) an antibody that comprises an L chain having the amino acid sequence of SEQ ID NO: 1676 as CDR1, the amino acid sequence of SEQ ID NO: 1678 as CDR2, and the amino acid sequence of SEQ ID NO: 1680 as CDR3;

(627) an antibody that comprises the H chain of (625) and the L chain of (626);

(628) an antibody that comprises an H chain having the amino acid sequence of SEQ ID NO: 2706 as VH;

(629) an antibody that comprises an L chain having the amino acid sequence of SEQ ID NO: 2708 as VL;

(630) an antibody that comprises the H chain of (628) and the L chain of (629);

IR-120 antibody:

(631) an antibody that comprises an H chain having the amino acid sequence of SEQ ID NO: 1686 as CDR1, the amino acid sequence of SEQ ID NO: 1688 as CDR2, and the amino acid sequence of SEQ ID NO: 1690 as CDR3;

(632) an antibody that comprises an L chain having the amino acid sequence of SEQ ID NO: 1692 as CDR1, the amino acid sequence of SEQ ID NO: 1694 as CDR2, and the amino acid sequence of SEQ ID NO: 1696 as CDR3;

(633) an antibody that comprises the H chain of (631) and the L chain of (632);

(634) an antibody that comprises an H chain having the amino acid sequence of SEQ ID NO: 2710 as VH;

(635) an antibody that comprises an L chain having the amino acid sequence of SEQ ID NO: 2712 as VL;

(636) an antibody that comprises the H chain of (634) and the L chain of (635);

IR-121 antibody:

(637) an antibody that comprises an H chain having the amino acid sequence of SEQ ID NO: 1702 as CDR1, the amino acid sequence of SEQ ID NO: 1704 as CDR2, and the amino acid sequence of SEQ ID NO: 1706 as CDR3;

(638) an antibody that comprises an L chain having the amino acid sequence of SEQ ID NO: 1708 as CDR1, the amino acid sequence of SEQ ID NO: 1710 as CDR2, and the amino acid sequence of SEQ ID NO: 1712 as CDR3;

(639) an antibody that comprises the H chain of (637) and the L chain of (638);

(640) an antibody that comprises an H chain having the amino acid sequence of SEQ ID NO: 2714 as VH;

(641) an antibody that comprises an L chain having the amino acid sequence of SEQ ID NO: 2716 as VL;

(642) an antibody that comprises the H chain of (640) and the L chain of (641); IR-122 antibody:

(643) an antibody that comprises an H chain having the amino acid sequence of SEQ ID NO: 1718 as CDR1, the amino acid sequence of SEQ ID NO: 1720 as CDR2, and the amino acid sequence of SEQ ID NO: 1722 as CDR3;

(644) an antibody that comprises an L chain having the amino acid sequence of SEQ ID NO: 1724 as CDR1, the amino acid sequence of SEQ ID NO: 1726 as CDR2, and the amino acid sequence of SEQ ID NO: 1728 as CDR3;

(645) an antibody that comprises the H chain of (643) and the L chain of (644);

(646) an antibody that comprises an H chain having the amino acid sequence of SEQ ID NO: 2718 as VH;

(647) an antibody that comprises an L chain having the amino acid sequence of SEQ ID NO: 2720 as VL;

(648) an antibody that comprises the H chain of (646) and the L chain of (647);

IR-123 antibody:

(649) an antibody that comprises an H chain having the amino acid sequence of SEQ ID NO: 1734 as CDR1, the amino acid sequence of SEQ ID NO: 1736 as CDR2, and the amino acid sequence of SEQ ID NO: 1738 as CDR3;

(650) an antibody that comprises an L chain having the amino acid sequence of SEQ ID NO: 1740 as CDR1, the amino acid sequence of SEQ ID NO: 1742 as CDR2, and the amino acid sequence of SEQ ID NO: 1744 as CDR3;

(651) an antibody that comprises the H chain of (649) and the L chain of (650);

(652) an antibody that comprises an H chain having the amino acid sequence of SEQ ID NO: 2722 as VH;

(653) an antibody that comprises an L chain having the amino acid sequence of SEQ ID NO: 2724 as VL;

(654) an antibody that comprises the H chain of (652) and the L chain of (653);

IR-124 antibody:
(655) an antibody that comprises an H chain having the amino acid sequence of SEQ ID NO: 1750 as CDR1, the amino acid sequence of SEQ ID NO: 1752 as CDR2, and the amino acid sequence of SEQ ID NO: 1754 as CDR3;
(656) an antibody that comprises an L chain having the amino acid sequence of SEQ ID NO: 1756 as CDR1, the amino acid sequence of SEQ ID NO: 1758 as CDR2, and the amino acid sequence of SEQ ID NO: 1760 as CDR3;
(657) an antibody that comprises the H chain of (655) and the L chain of (656);
(658) an antibody that comprises an H chain having the amino acid sequence of SEQ ID NO: 2726 as VH;
(659) an antibody that comprises an L chain having the amino acid sequence of SEQ ID NO: 2728 as VL;
(660) an antibody that comprises the H chain of (658) and the L chain of (659);
IR-125 antibody:
(661) an antibody that comprises an H chain having the amino acid sequence of SEQ ID NO: 1766 as CDR1, the amino acid sequence of SEQ ID NO: 1768 as CDR2, and the amino acid sequence of SEQ ID NO: 1770 as CDR3;
(662) an antibody that comprises an L chain having the amino acid sequence of SEQ ID NO: 1772 as CDR1, the amino acid sequence of SEQ ID NO: 1774 as CDR2, and the amino acid sequence of SEQ ID NO: 1776 as CDR3;
(663) an antibody that comprises the H chain of (661) and the L chain of (662);
(664) an antibody that comprises an H chain having the amino acid sequence of SEQ ID NO: 2730 as VH;
(665) an antibody that comprises an L chain having the amino acid sequence of SEQ ID NO: 2732 as VL;
(666) an antibody that comprises the H chain of (664) and the L chain of (665);
IR-126 antibody:
(667) an antibody that comprises an H chain having the amino acid sequence of SEQ ID NO: 1782 as CDR1, the amino acid sequence of SEQ ID NO: 1784 as CDR2, and the amino acid sequence of SEQ ID NO: 1786 as CDR3;
(668) an antibody that comprises an L chain having the amino acid sequence of SEQ ID NO: 1788 as CDR1, the amino acid sequence of SEQ ID NO: 1790 as CDR2, and the amino acid sequence of SEQ ID NO: 1792 as CDR3;
(669) an antibody that comprises the H chain of (667) and the L chain of (668);
(670) an antibody that comprises an H chain having the amino acid sequence of SEQ ID NO: 2734 as VH;
(671) an antibody that comprises an L chain having the amino acid sequence of SEQ ID NO: 2736 as VL;
(672) an antibody that comprises the H chain of (670) and the L chain of (671);
IR-127 antibody:
(673) an antibody that comprises an H chain having the amino acid sequence of SEQ ID NO: 1798 as CDR1, the amino acid sequence of SEQ ID NO: 1800 as CDR2, and the amino acid sequence of SEQ ID NO: 1802 as CDR3;
(674) an antibody that comprises an L chain having the amino acid sequence of SEQ ID NO: 1804 as CDR1, the amino acid sequence of SEQ ID NO: 1806 as CDR2, and the amino acid sequence of SEQ ID NO: 1808 as CDR3;
(675) an antibody that comprises the H chain of (673) and the L chain of (674);
(676) an antibody that comprises an H chain having the amino acid sequence of SEQ ID NO: 2738 as VH;
(677) an antibody that comprises an L chain having the amino acid sequence of SEQ ID NO: 2740 as VL;
(678) an antibody that comprises the H chain of (676) and the L chain of (677);
IR-128 antibody:
(679) an antibody that comprises an H chain having the amino acid sequence of SEQ ID NO: 1814 as CDR1, the amino acid sequence of SEQ ID NO: 1816 as CDR2, and the amino acid sequence of SEQ ID NO: 1818 as CDR3;
(680) an antibody that comprises an L chain having the amino acid sequence of SEQ ID NO: 1820 as CDR1, the amino acid sequence of SEQ ID NO: 1822 as CDR2, and the amino acid sequence of SEQ ID NO: 1824 as CDR3;
(681) an antibody that comprises the H chain of (679) and the L chain of (680);
(682) an antibody that comprises an H chain having the amino acid sequence of SEQ ID NO: 2742 as VH;
(683) an antibody that comprises an L chain having the amino acid sequence of SEQ ID NO: 2744 as VL;
(684) an antibody that comprises the H chain of (682) and the L chain of (683);
IR-129 antibody:
(685) an antibody that comprises an H chain having the amino acid sequence of SEQ ID NO: 1830 as CDR1, the amino acid sequence of SEQ ID NO: 1832 as CDR2, and the amino acid sequence of SEQ ID NO: 1834 as CDR3;
(686) an antibody that comprises an L chain having the amino acid sequence of SEQ ID NO: 1836 as CDR1, the amino acid sequence of SEQ ID NO: 1838 as CDR2, and the amino acid sequence of SEQ ID NO: 1840 as CDR3;
(687) an antibody that comprises the H chain of (685) and the L chain of (686);
(688) an antibody that comprises an H chain having the amino acid sequence of SEQ ID NO: 2746 as VH;
(689) an antibody that comprises an L chain having the amino acid sequence of SEQ ID NO: 2748 as VL;
(690) an antibody that comprises the H chain of (688) and the L chain of (689);
IR-131 antibody:
(691) an antibody that comprises an H chain having the amino acid sequence of SEQ ID NO: 1846 as CDR1, the amino acid sequence of SEQ ID NO: 1848 as CDR2, and the amino acid sequence of SEQ ID NO: 1850 as CDR3;
(692) an antibody that comprises an L chain having the amino acid sequence of SEQ ID NO: 1852 as CDR1, the amino acid sequence of SEQ ID NO: 1854 as CDR2, and the amino acid sequence of SEQ ID NO: 1856 as CDR3;
(693) an antibody that comprises the H chain of (691) and the L chain of (692);
(694) an antibody that comprises an H chain having the amino acid sequence of SEQ ID NO: 2750 as VH;
(695) an antibody that comprises an L chain having the amino acid sequence of SEQ ID NO: 2752 as VL;
(696) an antibody that comprises the H chain of (694) and the L chain of (695);
IR-132 antibody:
(697) an antibody that comprises an H chain having the amino acid sequence of SEQ ID NO: 1862 as CDR1, the amino acid sequence of SEQ ID NO: 1864 as CDR2, and the amino acid sequence of SEQ ID NO: 1866 as CDR3;
(698) an antibody that comprises an L chain having the amino acid sequence of SEQ ID NO: 1868 as CDR1, the amino acid sequence of SEQ ID NO: 1870 as CDR2, and the amino acid sequence of SEQ ID NO: 1872 as CDR3;
(699) an antibody that comprises the H chain of (697) and the L chain of (698);
(700) an antibody that comprises an H chain having the amino acid sequence of SEQ ID NO: 2754 as VH;

(701) an antibody that comprises an L chain having the amino acid sequence of SEQ ID NO: 2756 as VL;

(702) an antibody that comprises the H chain of (700) and the L chain of (701);

IR-133 antibody:

(703) an antibody that comprises an H chain having the amino acid sequence of SEQ ID NO: 1878 as CDR1, the amino acid sequence of SEQ ID NO: 1880 as CDR2, and the amino acid sequence of SEQ ID NO: 1882 as CDR3;

(704) an antibody that comprises an L chain having the amino acid sequence of SEQ ID NO: 1884 as CDR1, the amino acid sequence of SEQ ID NO: 1886 as CDR2, and the amino acid sequence of SEQ ID NO: 1888 as CDR3;

(705) an antibody that comprises the H chain of (703) and the L chain of (704);

(706) an antibody that comprises an H chain having the amino acid sequence of SEQ ID NO: 2758 as VH;

(707) an antibody that comprises an L chain having the amino acid sequence of SEQ ID NO: 2760 as VL;

(708) an antibody that comprises the H chain of (706) and the L chain of (707);

IR-134 antibody:

(709) an antibody that comprises an H chain having the amino acid sequence of SEQ ID NO: 1894 as CDR1, the amino acid sequence of SEQ ID NO: 1896 as CDR2, and the amino acid sequence of SEQ ID NO: 1898 as CDR3;

(710) an antibody that comprises an L chain having the amino acid sequence of SEQ ID NO: 1900 as CDR1, the amino acid sequence of SEQ ID NO: 1902 as CDR2, and the amino acid sequence of SEQ ID NO: 1904 as CDR3;

(711) an antibody that comprises the H chain of (709) and the L chain of (710);

(712) an antibody that comprises an H chain having the amino acid sequence of SEQ ID NO: 2762 as VH;

(713) an antibody that comprises an L chain having the amino acid sequence of SEQ ID NO: 2764 as VL;

(714) an antibody that comprises the H chain of (712) and the L chain of (713);

IR-135 antibody:

(715) an antibody that comprises an H chain having the amino acid sequence of SEQ ID NO: 1910 as CDR1, the amino acid sequence of SEQ ID NO: 1912 as CDR2, and the amino acid sequence of SEQ ID NO: 1914 as CDR3;

(716) an antibody that comprises an L chain having the amino acid sequence of SEQ ID NO: 1916 as CDR1, the amino acid sequence of SEQ ID NO: 1918 as CDR2, and the amino acid sequence of SEQ ID NO: 1920 as CDR3;

(717) an antibody that comprises the H chain of (715) and the L chain of (716);

(718) an antibody that comprises an H chain having the amino acid sequence of SEQ ID NO: 2766 as VH;

(719) an antibody that comprises an L chain having the amino acid sequence of SEQ ID NO: 2768 as VL;

(720) an antibody that comprises the H chain of (718) and the L chain of (719);

IR-136 antibody:

(721) an antibody that comprises an H chain having the amino acid sequence of SEQ ID NO: 1926 as CDR1, the amino acid sequence of SEQ ID NO: 1928 as CDR2, and the amino acid sequence of SEQ ID NO: 1930 as CDR3;

(722) an antibody that comprises an L chain having the amino acid sequence of SEQ ID NO: 1932 as CDR1, the amino acid sequence of SEQ ID NO: 1934 as CDR2, and the amino acid sequence of SEQ ID NO: 1936 as CDR3;

(723) an antibody that comprises the H chain of (721) and the L chain of (722);

(724) an antibody that comprises an H chain having the amino acid sequence of SEQ ID NO: 2770 as VH;

(725) an antibody that comprises an L chain having the amino acid sequence of SEQ ID NO: 2772 as VL;

(726) an antibody that comprises the H chain of (724) and the L chain of (725);

IR-137 antibody:

(727) an antibody that comprises an H chain having the amino acid sequence of SEQ ID NO: 1942 as CDR1, the amino acid sequence of SEQ ID NO: 1944 as CDR2, and the amino acid sequence of SEQ ID NO: 1946 as CDR3;

(728) an antibody that comprises an L chain having the amino acid sequence of SEQ ID NO: 1948 as CDR1, the amino acid sequence of SEQ ID NO: 1950 as CDR2, and the amino acid sequence of SEQ ID NO: 1952 as CDR3;

(729) an antibody that comprises the H chain of (727) and the L chain of (728);

(730) an antibody that comprises an H chain having the amino acid sequence of SEQ ID NO: 2774 as VH;

(731) an antibody that comprises an L chain having the amino acid sequence of SEQ ID NO: 2776 as VL;

(732) an antibody that comprises the H chain of (730) and the L chain of (731);

IR-138 antibody:

(733) an antibody that comprises an H chain having the amino acid sequence of SEQ ID NO: 1958 as CDR1, the amino acid sequence of SEQ ID NO: 1960 as CDR2, and the amino acid sequence of SEQ ID NO: 1962 as CDR3;

(734) an antibody that comprises an L chain having the amino acid sequence of SEQ ID NO: 1964 as CDR1, the amino acid sequence of SEQ ID NO: 1966 as CDR2, and the amino acid sequence of SEQ ID NO: 1968 as CDR3;

(735) an antibody that comprises the H chain of (733) and the L chain of (734);

(736) an antibody that comprises an H chain having the amino acid sequence of SEQ ID NO: 2778 as VH;

(737) an antibody that comprises an L chain having the amino acid sequence of SEQ ID NO: 2780 as VL;

(738) an antibody that comprises the H chain of (736) and the L chain of (737);

IR-139 antibody:

(739) an antibody that comprises an H chain having the amino acid sequence of SEQ ID NO: 1974 as CDR1, the amino acid sequence of SEQ ID NO: 1976 as CDR2, and the amino acid sequence of SEQ ID NO: 1978 as CDR3;

(740) an antibody that comprises an L chain having the amino acid sequence of SEQ ID NO: 1980 as CDR1, the amino acid sequence of SEQ ID NO: 1982 as CDR2, and the amino acid sequence of SEQ ID NO: 1984 as CDR3;

(741) an antibody that comprises the H chain of (739) and the L chain of (740);

(742) an antibody that comprises an H chain having the amino acid sequence of SEQ ID NO: 2782 as VH;

(743) an antibody that comprises an L chain having the amino acid sequence of SEQ ID NO: 2784 as VL;

(744) an antibody that comprises the H chain of (742) and the L chain of (743);

IR-140 antibody:

(745) an antibody that comprises an H chain having the amino acid sequence of SEQ ID NO: 1990 as CDR1, the amino acid sequence of SEQ ID NO: 1992 as CDR2, and the amino acid sequence of SEQ ID NO: 1994 as CDR3;

(746) an antibody that comprises an L chain having the amino acid sequence of SEQ ID NO: 1996 as CDR1, the amino acid sequence of SEQ ID NO: 1998 as CDR2, and the amino acid sequence of SEQ ID NO: 2000 as CDR3;

(747) an antibody that comprises the H chain of (745) and the L chain of (746);

(748) an antibody that comprises an H chain having the amino acid sequence of SEQ ID NO: 2786 as VH;

(749) an antibody that comprises an L chain having the amino acid sequence of SEQ ID NO: 2788 as VL;

(750) an antibody that comprises the H chain of (748) and the L chain of (749);

IR-141 antibody:

(751) an antibody that comprises an H chain having the amino acid sequence of SEQ ID NO: 2006 as CDR1, the amino acid sequence of SEQ ID NO: 2008 as CDR2, and the amino acid sequence of SEQ ID NO: 2010 as CDR3;

(752) an antibody that comprises an L chain having the amino acid sequence of SEQ ID NO: 2012 as CDR1, the amino acid sequence of SEQ ID NO: 2014 as CDR2, and the amino acid sequence of SEQ ID NO: 2016 as CDR3;

(753) an antibody that comprises the H chain of (751) and the L chain of (752);

(754) an antibody that comprises an H chain having the amino acid sequence of SEQ ID NO: 2790 as VH;

(755) an antibody that comprises an L chain having the amino acid sequence of SEQ ID NO: 2792 as VL;

(756) an antibody that comprises the H chain of (754) and the L chain of (755);

IR-142 antibody:

(757) an antibody that comprises an H chain having the amino acid sequence of SEQ ID NO: 2022 as CDR1, the amino acid sequence of SEQ ID NO: 2024 as CDR2, and the amino acid sequence of SEQ ID NO: 2026 as CDR3;

(758) an antibody that comprises an L chain having the amino acid sequence of SEQ ID NO: 2028 as CDR1, the amino acid sequence of SEQ ID NO: 2030 as CDR2, and the amino acid sequence of SEQ ID NO: 2032 as CDR3;

(759) an antibody that comprises the H chain of (757) and the L chain of (758);

(760) an antibody that comprises an H chain having the amino acid sequence of SEQ ID NO: 2794 as VH;

(761) an antibody that comprises an L chain having the amino acid sequence of SEQ ID NO: 2796 as VL;

(762) an antibody that comprises the H chain of (760) and the L chain of (761);

IR-143 antibody:

(763) an antibody that comprises an H chain having the amino acid sequence of SEQ ID NO: 2038 as CDR1, the amino acid sequence of SEQ ID NO: 2040 as CDR2, and the amino acid sequence of SEQ ID NO: 2042 as CDR3;

(764) an antibody that comprises an L chain having the amino acid sequence of SEQ ID NO: 2044 as CDR1, the amino acid sequence of SEQ ID NO: 2046 as CDR2, and the amino acid sequence of SEQ ID NO: 2048 as CDR3;

(765) an antibody that comprises the H chain of (763) and the L chain of (764);

(766) an antibody that comprises an H chain having the amino acid sequence of SEQ ID NO: 2798 as VH;

(767) an antibody that comprises an L chain having the amino acid sequence of SEQ ID NO: 2800 as VL;

(768) an antibody that comprises the H chain of (766) and the L chain of (767);

IR-144 antibody:

(769) an antibody that comprises an H chain having the amino acid sequence of SEQ ID NO: 2054 as CDR1, the amino acid sequence of SEQ ID NO: 2056 as CDR2, and the amino acid sequence of SEQ ID NO: 2058 as CDR3;

(770) an antibody that comprises an L chain having the amino acid sequence of SEQ ID NO: 2060 as CDR1, the amino acid sequence of SEQ ID NO: 2062 as CDR2, and the amino acid sequence of SEQ ID NO: 2064 as CDR3;

(771) an antibody that comprises the H chain of (769) and the L chain of (770);

(772) an antibody that comprises an H chain having the amino acid sequence of SEQ ID NO: 2802 as VH;

(773) an antibody that comprises an L chain having the amino acid sequence of SEQ ID NO: 2804 as VL;

(774) an antibody that comprises the H chain of (772) and the L chain of (773);

IR-145 antibody:

(775) an antibody that comprises an H chain having the amino acid sequence of SEQ ID NO: 2070 as CDR1, the amino acid sequence of SEQ ID NO: 2072 as CDR2, and the amino acid sequence of SEQ ID NO: 2074 as CDR3;

(776) an antibody that comprises an L chain having the amino acid sequence of SEQ ID NO: 2076 as CDR1, the amino acid sequence of SEQ ID NO: 2078 as CDR2, and the amino acid sequence of SEQ ID NO: 2080 as CDR3;

(777) an antibody that comprises the H chain of (775) and the L chain of (776);

(778) an antibody that comprises an H chain having the amino acid sequence of SEQ ID NO: 2806 as VH;

(779) an antibody that comprises an L chain having the amino acid sequence of SEQ ID NO: 2808 as VL;

(780) an antibody that comprises the H chain of (778) and the L chain of (779);

IR-146 antibody:

(781) an antibody that comprises an H chain having the amino acid sequence of SEQ ID NO: 2086 as CDR1, the amino acid sequence of SEQ ID NO: 2088 as CDR2, and the amino acid sequence of SEQ ID NO: 2090 as CDR3;

(782) an antibody that comprises an L chain having the amino acid sequence of SEQ ID NO: 2092 as CDR1, the amino acid sequence of SEQ ID NO: 2094 as CDR2, and the amino acid sequence of SEQ ID NO: 2096 as CDR3;

(783) an antibody that comprises the H chain of (781) and the L chain of (782);

(784) an antibody that comprises an H chain having the amino acid sequence of SEQ ID NO: 2810 as VH;

(785) an antibody that comprises an L chain having the amino acid sequence of SEQ ID NO: 2812 as VL;

(786) an antibody that comprises the H chain of (784) and the L chain of (785);

IR-147 antibody:

(787) an antibody that comprises an H chain having the amino acid sequence of SEQ ID NO: 2102 as CDR1, the amino acid sequence of SEQ ID NO: 2104 as CDR2, and the amino acid sequence of SEQ ID NO: 2106 as CDR3;

(788) an antibody that comprises an L chain having the amino acid sequence of SEQ ID NO: 2108 as CDR1, the amino acid sequence of SEQ ID NO: 2110 as CDR2, and the amino acid sequence of SEQ ID NO: 2112 as CDR3;

(789) an antibody that comprises the H chain of (787) and the L chain of (788);

(790) an antibody that comprises an H chain having the amino acid sequence of SEQ ID NO: 2814 as VH;

(791) an antibody that comprises an L chain having the amino acid sequence of SEQ ID NO: 2816 as VL;

(792) an antibody that comprises the H chain of (790) and the L chain of (791);

IR-149 antibody:

(793) an antibody that comprises an H chain having the amino acid sequence of SEQ ID NO: 2118 as CDR1, the amino acid sequence of SEQ ID NO: 2120 as CDR2, and the amino acid sequence of SEQ ID NO: 2122 as CDR3;

(794) an antibody that comprises an L chain having the amino acid sequence of SEQ ID NO: 2124 as CDR1, the amino acid sequence of SEQ ID NO: 2126 as CDR2, and the amino acid sequence of SEQ ID NO: 2128 as CDR3;

(795) an antibody that comprises the H chain of (793) and the L chain of (794);

(796) an antibody that comprises an H chain having the amino acid sequence of SEQ ID NO: 2818 as VH;

(797) an antibody that comprises an L chain having the amino acid sequence of SEQ ID NO: 2820 as VL;

(798) an antibody that comprises the H chain of (796) and the L chain of (797);

IR-150 antibody:

(799) an antibody that comprises an H chain having the amino acid sequence of SEQ ID NO: 2134 as CDR1, the amino acid sequence of SEQ ID NO: 2136 as CDR2, and the amino acid sequence of SEQ ID NO: 2138 as CDR3;

(800) an antibody that comprises an L chain having the amino acid sequence of SEQ ID NO: 2140 as CDR1, the amino acid sequence of SEQ ID NO: 2142 as CDR2, and the amino acid sequence of SEQ ID NO: 2144 as CDR3;

(801) an antibody that comprises the H chain of (799) and the L chain of (800);

(802) an antibody that comprises an H chain having the amino acid sequence of SEQ ID NO: 2822 as VH;

(803) an antibody that comprises an L chain having the amino acid sequence of SEQ ID NO: 2824 as VL;

(804) an antibody that comprises the H chain of (802) and the L chain of (803);

IR-151 antibody:

(805) an antibody that comprises an H chain having the amino acid sequence of SEQ ID NO: 2150 as CDR1, the amino acid sequence of SEQ ID NO: 2152 as CDR2, and the amino acid sequence of SEQ ID NO: 2154 as CDR3;

(806) an antibody that comprises an L chain having the amino acid sequence of SEQ ID NO: 2156 as CDR1, the amino acid sequence of SEQ ID NO: 2158 as CDR2, and the amino acid sequence of SEQ ID NO: 2160 as CDR3;

(807) an antibody that comprises the H chain of (805) and the L chain of (806);

(808) an antibody that comprises an H chain having the amino acid sequence of SEQ ID NO: 2826 as VH;

(809) an antibody that comprises an L chain having the amino acid sequence of SEQ ID NO: 2828 as VL;

(810) an antibody that comprises the H chain of (808) and the L chain of (809);

IR-152 antibody:

(811) an antibody that comprises an H chain having the amino acid sequence of SEQ ID NO: 2166 as CDR1, the amino acid sequence of SEQ ID NO: 2168 as CDR2, and the amino acid sequence of SEQ ID NO: 2170 as CDR3;

(812) an antibody that comprises an L chain having the amino acid sequence of SEQ ID NO: 2172 as CDR1, the amino acid sequence of SEQ ID NO: 2174 as CDR2, and the amino acid sequence of SEQ ID NO: 2176 as CDR3;

(813) an antibody that comprises the H chain of (811) and the L chain of (812);

(814) an antibody that comprises an H chain having the amino acid sequence of SEQ ID NO: 2830 as VH;

(815) an antibody that comprises an L chain having the amino acid sequence of SEQ ID NO: 2832 as VL;

(816) an antibody that comprises the H chain of (814) and the L chain of (815);

IR-153 antibody:

(817) an antibody that comprises an H chain having the amino acid sequence of SEQ ID NO: 2182 as CDR1, the amino acid sequence of SEQ ID NO: 2184 as CDR2, and the amino acid sequence of SEQ ID NO: 2186 as CDR3;

(818) an antibody that comprises an L chain having the amino acid sequence of SEQ ID NO: 2188 as CDR1, the amino acid sequence of SEQ ID NO: 2190 as CDR2, and the amino acid sequence of SEQ ID NO: 2192 as CDR3;

(819) an antibody that comprises the H chain of (817) and the L chain of (818);

(820) an antibody that comprises an H chain having the amino acid sequence of SEQ ID NO: 2834 as VH;

(821) an antibody that comprises an L chain having the amino acid sequence of SEQ ID NO: 2836 as VL;

(822) an antibody that comprises the H chain of (820) and the L chain of (821);

IR-154 antibody:

(823) an antibody that comprises an H chain having the amino acid sequence of SEQ ID NO: 2198 as CDR1, the amino acid sequence of SEQ ID NO: 2200 as CDR2, and the amino acid sequence of SEQ ID NO: 2202 as CDR3;

(824) an antibody that comprises an L chain having the amino acid sequence of SEQ ID NO: 2204 as CDR1, the amino acid sequence of SEQ ID NO: 2206 as CDR2, and the amino acid sequence of SEQ ID NO: 2208 as CDR3;

(825) an antibody that comprises the H chain of (823) and the L chain of (824);

(826) an antibody that comprises an H chain having the amino acid sequence of SEQ ID NO: 2838 as VH;

(827) an antibody that comprises an L chain having the amino acid sequence of SEQ ID NO: 2840 as VL;

(828) an antibody that comprises the H chain of (826) and the L chain of (827);

IR-155 antibody:

(829) an antibody that comprises an H chain having the amino acid sequence of SEQ ID NO: 2214 as CDR1, the amino acid sequence of SEQ ID NO: 2216 as CDR2, and the amino acid sequence of SEQ ID NO: 2218 as CDR3;

(830) an antibody that comprises an L chain having the amino acid sequence of SEQ ID NO: 2220 as CDR1, the amino acid sequence of SEQ ID NO: 2222 as CDR2, and the amino acid sequence of SEQ ID NO: 2224 as CDR3;

(831) an antibody that comprises the H chain of (829) and the L chain of (830);

(832) an antibody that comprises an H chain having the amino acid sequence of SEQ ID NO: 2842 as VH;

(833) an antibody that comprises an L chain having the amino acid sequence of SEQ ID NO: 2844 as VL;

(834) an antibody that comprises the H chain of (832) and the L chain of (833);

IR-156 antibody:

(835) an antibody that comprises an H chain having the amino acid sequence of SEQ ID NO: 2230 as CDR1, the amino acid sequence of SEQ ID NO: 2232 as CDR2, and the amino acid sequence of SEQ ID NO: 2234 as CDR3;

(836) an antibody that comprises an L chain having the amino acid sequence of SEQ ID NO: 2236 as CDR1, the amino acid sequence of SEQ ID NO: 2238 as CDR2, and the amino acid sequence of SEQ ID NO: 2240 as CDR3;

(837) an antibody that comprises the H chain of (835) and the L chain of (836);

(838) an antibody that comprises an H chain having the amino acid sequence of SEQ ID NO: 2846 as VH;

(839) an antibody that comprises an L chain having the amino acid sequence of SEQ ID NO: 2848 as VL;

(840) an antibody that comprises the H chain of (838) and the L chain of (839);

IR-157 antibody:

(841) an antibody that comprises an H chain having the amino acid sequence of SEQ ID NO: 2246 as CDR1, the amino acid sequence of SEQ ID NO: 2248 as CDR2, and the amino acid sequence of SEQ ID NO: 2250 as CDR3;

(842) an antibody that comprises an L chain having the amino acid sequence of SEQ ID NO: 2252 as CDR1, the amino acid sequence of SEQ ID NO: 2254 as CDR2, and the amino acid sequence of SEQ ID NO: 2256 as CDR3;

(843) an antibody that comprises the H chain of (841) and the L chain of (842);

(844) an antibody that comprises an H chain having the amino acid sequence of SEQ ID NO: 2850 as VH;

(845) an antibody that comprises an L chain having the amino acid sequence of SEQ ID NO: 2852 as VL;

(846) an antibody that comprises the H chain of (844) and the L chain of (845);

IR-158 antibody:

(847) an antibody that comprises an H chain having the amino acid sequence of SEQ ID NO: 2262 as CDR1, the amino acid sequence of SEQ ID NO: 2264 as CDR2, and the amino acid sequence of SEQ ID NO: 2266 as CDR3;

(848) an antibody that comprises an L chain having the amino acid sequence of SEQ ID NO: 2268 as CDR1, the amino acid sequence of SEQ ID NO: 2270 as CDR2, and the amino acid sequence of SEQ ID NO: 2272 as CDR3;

(849) an antibody that comprises the H chain of (847) and the L chain of (848);

(850) an antibody that comprises an H chain having the amino acid sequence of SEQ ID NO: 2854 as VH;

(851) an antibody that comprises an L chain having the amino acid sequence of SEQ ID NO: 2856 as VL;

(852) an antibody that comprises the H chain of (850) and the L chain of (851);

IR-159 antibody:

(853) an antibody that comprises an H chain having the amino acid sequence of SEQ ID NO: 2278 as CDR1, the amino acid sequence of SEQ ID NO: 2280 as CDR2, and the amino acid sequence of SEQ ID NO: 2282 as CDR3;

(854) an antibody that comprises an L chain having the amino acid sequence of SEQ ID NO: 2284 as CDR1, the amino acid sequence of SEQ ID NO: 2286 as CDR2, and the amino acid sequence of SEQ ID NO: 2288 as CDR3;

(855) an antibody that comprises the H chain of (853) and the L chain of (854);

(856) an antibody that comprises an H chain having the amino acid sequence of SEQ ID NO: 2858 as VH;

(857) an antibody that comprises an L chain having the amino acid sequence of SEQ ID NO: 2860 as VL;

(858) an antibody that comprises the H chain of (856) and the L chain of (857);

IR-160 antibody:

(859) an antibody that comprises an H chain having the amino acid sequence of SEQ ID NO: 2866 as CDR1, the amino acid sequence of SEQ ID NO: 2868 as CDR2, and the amino acid sequence of SEQ ID NO: 2870 as CDR3;

(860) an antibody that comprises an L chain having the amino acid sequence of SEQ ID NO: 2872 as CDR1, the amino acid sequence of SEQ ID NO: 2874 as CDR2, and the amino acid sequence of SEQ ID NO: 2876 as CDR3;

(861) an antibody that comprises the H chain of (859) and the L chain of (860);

(862) an antibody that comprises an H chain having the amino acid sequence of SEQ ID NO: 2862 as VH;

(863) an antibody that comprises an L chain having the amino acid sequence of SEQ ID NO: 2864 as VL;

(864) an antibody that comprises the H chain of (862) and the L chain of (863);

IR-161 antibody:

(865) an antibody that comprises an H chain having the amino acid sequence of SEQ ID NO: 2882 as CDR1, the amino acid sequence of SEQ ID NO: 2884 as CDR2, and the amino acid sequence of SEQ ID NO: 2886 as CDR3;

(866) an antibody that comprises an L chain having the amino acid sequence of SEQ ID NO: 2888 as CDR1, the amino acid sequence of SEQ ID NO: 2890 as CDR2, and the amino acid sequence of SEQ ID NO: 2892 as CDR3;

(867) an antibody that comprises the H chain of (865) and the L chain of (866);

(868) an antibody that comprises an H chain having the amino acid sequence of SEQ ID NO: 2878 as VH;

(869) an antibody that comprises an L chain having the amino acid sequence of SEQ ID NO: 2880 as VL;

(870) an antibody that comprises the H chain of (868) and the L chain of (869);

(871) an antibody that comprises one or more amino acid substitutions, deletions, additions, and/or insertions in the antibody of any one of (1) to (870), which has equivalent activity to the antibody of any one of (1) to (870);

(872) an antibody that binds to the epitope bound by the antibody of any one of (1) to (870).

IR-001 antibody:

An example of the VH in the above-mentioned H chain having the amino acid sequence of SEQ ID NO: 6 (sequence of the IR-001 antibody H-chain CDR1) as CDR1, the amino acid sequence of SEQ ID NO: 8 (sequence of the IR-001 antibody H-chain CDR2) as CDR2, and the amino acid sequence of SEQ ID NO: 10 (sequence of the IR-001 antibody H-chain CDR3) as CDR3 of (1) is a VH comprising the amino acid sequence of SEQ ID NO: 2, more preferably, a VH comprising the amino acid sequence of SEQ ID NO: 2290 (sequence of the IR-001 antibody VH)

An example of the VL in the above-mentioned L chain having the amino acid sequence of SEQ ID NO: 12 (sequence of the IR-001 antibody L-chain CDR1) as CDR1, the amino acid sequence of SEQ ID NO: 14 (sequence of the IR-001 antibody L-chain CDR2) as CDR2, and the amino acid sequence of SEQ ID NO: 16 (sequence of the IR-001 antibody L-chain CDR3) as CDR3 of (2) is a VL comprising the amino acid sequence of SEQ ID NO: 4, more preferably, a VL comprising the amino acid sequence of SEQ ID NO: 2292 (sequence of the IR-001 antibody VL)

IR-002 antibody:

An example of the VH in the above-mentioned H chain having the amino acid sequence of SEQ ID NO: 22 (sequence of the IR-002 antibody H-chain CDR1) as CDR1, the amino acid sequence of SEQ ID NO: 24 (sequence of the IR-002 antibody H-chain CDR2) as CDR2, and the amino acid sequence of SEQ ID NO: 26 (sequence of the IR-002 antibody H-chain CDR3) as CDR3 of (7) is a VH comprising the amino acid sequence of SEQ ID NO: 2294 (sequence of the IR-002 antibody VH)

An example of the VL in the above-mentioned L chain having the amino acid sequence of SEQ ID NO: 28 (sequence of the IR-002 antibody L-chain CDR1) as CDR1, the amino acid sequence of SEQ ID NO: 30 (sequence of the IR-002 antibody L-chain CDR2) as CDR2, and the amino acid sequence of SEQ ID NO: 32 (sequence of the IR-002 antibody L-chain CDR3) as CDR3 of (8) is a VL comprising the amino acid sequence of SEQ ID NO: 20, more preferably, a VL comprising the amino acid sequence of SEQ ID NO: 2296 (sequence of the IR-002 antibody VL)

IR-004 antibody:

An example of the VH in the above-mentioned H chain having the amino acid sequence of SEQ ID NO: 38 (sequence of the IR-004 antibody H-chain CDR1) as CDR1, the amino acid sequence of SEQ ID NO: 40 (sequence of the IR-004 antibody H-chain CDR2) as CDR2, and the amino acid sequence of SEQ ID NO: 42 (sequence of the IR-004 antibody H-chain CDR3) as CDR3 of (13) is a VH comprising the amino acid sequence of SEQ ID NO: 2298 (sequence of the IR-004 antibody VH)

An example of the VL in the above-mentioned L chain having the amino acid sequence of SEQ ID NO: 44 (sequence of the IR-004 antibody L-chain CDR1) as CDR1, the amino acid sequence of SEQ ID NO: 46 (sequence of the IR-004 antibody L-chain CDR2) as CDR2, and the amino acid sequence of SEQ ID NO: 48 (sequence of the IR-004 antibody L-chain CDR3) as CDR3 of (14) is a VL comprising the amino acid sequence of SEQ ID NO: 36, more preferably, a VL comprising the amino acid sequence of SEQ ID NO: 2300 (sequence of the IR-004 antibody VL)

IR-005 antibody:

An example of the VH in the above-mentioned H chain having the amino acid sequence of SEQ ID NO: 54 (sequence of the IR-005 antibody H-chain CDR1) as CDR1, the amino acid sequence of SEQ ID NO: 56 (sequence of the IR-005 antibody H-chain CDR2) as CDR2, and the amino acid sequence of SEQ ID NO: 58 (sequence of the IR-005 antibody H-chain CDR3) as CDR3 of (19) is a VH comprising the amino acid sequence of SEQ ID NO: 2302 (sequence of the IR-005 antibody VH)

An example of the VL in the above-mentioned L chain having the amino acid sequence of SEQ ID NO: 60 (sequence of the IR-005 antibody L-chain CDR1) as CDR1, the amino acid sequence of SEQ ID NO: 62 (sequence of the IR-005 antibody L-chain CDR2) as CDR2, and the amino acid sequence of SEQ ID NO: 64 (sequence of the IR-005 antibody L-chain CDR3) as CDR3 of (20) is a VL comprising the amino acid sequence of SEQ ID NO: 52, more preferably, a VL comprising the amino acid sequence of SEQ ID NO: 2304 (sequence of the IR-005 antibody VL)

IR-006 antibody:

An example of the VH in the above-mentioned H chain having the amino acid sequence of SEQ ID NO: 70 (sequence of the IR-006 antibody H-chain CDR1) as CDR1, the amino acid sequence of SEQ ID NO: 72 (sequence of the IR-006 antibody H-chain CDR2) as CDR2, and the amino acid sequence of SEQ ID NO: 74 (sequence of the IR-006 antibody H-chain CDR3) as CDR3 of (25) is a VH comprising the amino acid sequence of SEQ ID NO: 2306 (sequence of the IR-006 antibody VH)

An example of the VL in the above-mentioned L chain having the amino acid sequence of SEQ ID NO: 76 (sequence of the IR-006 antibody L-chain CDR1) as CDR1, the amino acid sequence of SEQ ID NO: 78 (sequence of the IR-006 antibody L-chain CDR2) as CDR2, and the amino acid sequence of SEQ ID NO: 80 (sequence of the IR-006 antibody L-chain CDR3) as CDR3 of (26) is a VL comprising the amino acid sequence of SEQ ID NO: 68, more preferably, a VL comprising the amino acid sequence of SEQ ID NO: 2308 (sequence of the IR-006 antibody VL)

IR-007 antibody:

An example of the VH in the above-mentioned H chain having the amino acid sequence of SEQ ID NO: 86 (sequence of the IR-007 antibody H-chain CDR1) as CDR1, the amino acid sequence of SEQ ID NO: 88 (sequence of the IR-007 antibody H-chain CDR2) as CDR2, and the amino acid sequence of SEQ ID NO: 90 (sequence of the IR-007 antibody H-chain CDR3) as CDR3 of (31) is a VH comprising the amino acid sequence of SEQ ID NO: 2310 (sequence of the IR-007 antibody VH)

An example of the VL in the above-mentioned L chain having the amino acid sequence of SEQ ID NO: 92 (sequence of the IR-007 antibody L-chain CDR1) as CDR1, the amino acid sequence of SEQ ID NO: 94 (sequence of the IR-007 antibody L-chain CDR2) as CDR2, and the amino acid sequence of SEQ ID NO: 96 (sequence of the IR-007 antibody L-chain CDR3) as CDR3 of (32) is a VL comprising the amino acid sequence of SEQ ID NO: 84, more preferably, a VL comprising the amino acid sequence of SEQ ID NO: 2312 (sequence of the IR-007 antibody VL)

IR-008 antibody:

An example of the VH in the above-mentioned H chain having the amino acid sequence of SEQ ID NO: 102 (sequence of the IR-008 antibody H-chain CDR1) as CDR1, the amino acid sequence of SEQ ID NO: 104 (sequence of the IR-008 antibody H-chain CDR2) as CDR2, and the amino acid sequence of SEQ ID NO: 106 (sequence of the IR-008 antibody H-chain CDR3) as CDR3 of (37) is a VH comprising the amino acid sequence of SEQ ID NO: 2314 (sequence of the IR-008 antibody VH)

An example of the VL in the above-mentioned L chain having the amino acid sequence of SEQ ID NO: 108 (sequence of the IR-008 antibody L-chain CDR1) as CDR1, the amino acid sequence of SEQ ID NO: 110 (sequence of the IR-008 antibody L-chain CDR2) as CDR2, and the amino acid sequence of SEQ ID NO: 112 (sequence of the IR-008 antibody L-chain CDR3) as CDR3 of (38) is a VL comprising the amino acid sequence of SEQ ID NO: 100, more preferably, a VL comprising the amino acid sequence of SEQ ID NO: 2316 (sequence of the IR-008 antibody VL)

IR-011 antibody:

An example of the VH in the above-mentioned H chain having the amino acid sequence of SEQ ID NO: 118 (sequence of the IR-011 antibody H-chain CDR1) as CDR1, the amino acid sequence of SEQ ID NO: 120 (sequence of the IR-011 antibody H-chain CDR2) as CDR2, and the amino acid sequence of SEQ ID NO: 122 (sequence of the IR-011 antibody H-chain CDR3) as CDR3 of (43) is a VH comprising the amino acid sequence of SEQ ID NO: 2318 (sequence of the IR-011 antibody VH)

An example of the VL in the above-mentioned L chain having the amino acid sequence of SEQ ID NO: 124 (sequence of the IR-011 antibody L-chain CDR1) as CDR1, the amino acid sequence of SEQ ID NO: 126 (sequence of the IR-011 antibody L-chain CDR2) as CDR2, and the amino acid sequence of SEQ ID NO: 128 (sequence of the IR-011 antibody L-chain CDR3) as CDR3 of (44) is a VL comprising the amino acid sequence of SEQ ID NO: 116, more preferably, a VL comprising the amino acid sequence of SEQ ID NO: 2320 (sequence of the IR-011 antibody VL)

IR-012 antibody:

An example of the VH in the above-mentioned H chain having the amino acid sequence of SEQ ID NO: 134 (sequence of the IR-012 antibody H-chain CDR1) as CDR1, the amino acid sequence of SEQ ID NO: 136 (sequence of the IR-012 antibody H-chain CDR2) as CDR2, and the amino acid sequence of SEQ ID NO: 138 (sequence of the IR-012 antibody H-chain CDR3) as CDR3 of (49) is a VH comprising the amino acid sequence of SEQ ID NO: 2322 (sequence of the IR-012 antibody VH)

An example of the VL in the above-mentioned L chain having the amino acid sequence of SEQ ID NO: 140 (sequence of the IR-012 antibody L-chain CDR1) as CDR1, the amino acid sequence of SEQ ID NO: 142 (sequence of the IR-012 antibody L-chain CDR2) as CDR2, and the amino acid sequence of SEQ ID NO: 144 (sequence of the IR-012 antibody L-chain CDR3) as CDR3 of (50) is a VL comprising the amino acid sequence of SEQ ID NO: 132, more preferably, a VL comprising the amino acid sequence of SEQ ID NO: 2324 (sequence of the IR-012 antibody VL)

IR-013 antibody:
An example of the VH in the above-mentioned H chain having the amino acid sequence of SEQ ID NO: 150 (sequence of the IR-013 antibody H-chain CDR1) as CDR1, the amino acid sequence of SEQ ID NO: 152 (sequence of the IR-013 antibody H-chain CDR2) as CDR2, and the amino acid sequence of SEQ ID NO: 154 (sequence of the IR-013 antibody H-chain CDR3) as CDR3 of (55) is a VH comprising the amino acid sequence of SEQ ID NO: 2326 (sequence of the IR-013 antibody VH)

An example of the VL in the above-mentioned L chain having the amino acid sequence of SEQ ID NO: 156 (sequence of the IR-013 antibody L-chain CDR1) as CDR1, the amino acid sequence of SEQ ID NO: 158 (sequence of the IR-013 antibody L-chain CDR2) as CDR2, and the amino acid sequence of SEQ ID NO: 160 (sequence of the IR-013 antibody L-chain CDR3) as CDR3 of (56) is a VL comprising the amino acid sequence of SEQ ID NO: 148, more preferably, a VL comprising the amino acid sequence of SEQ ID NO: 2328 (sequence of the IR-013 antibody VL)

IR-014 antibody:
An example of the VH in the above-mentioned H chain having the amino acid sequence of SEQ ID NO: 166 (sequence of the IR-014 antibody H-chain CDR1) as CDR1, the amino acid sequence of SEQ ID NO: 168 (sequence of the IR-014 antibody H-chain CDR2) as CDR2, and the amino acid sequence of SEQ ID NO: 170 (sequence of the IR-014 antibody H-chain CDR3) as CDR3 of (61) is a VH comprising the amino acid sequence of SEQ ID NO: 2330 (sequence of the IR-014 antibody VH)

An example of the VL in the above-mentioned L chain having the amino acid sequence of SEQ ID NO: 172 (sequence of the IR-014 antibody L-chain CDR1) as CDR1, the amino acid sequence of SEQ ID NO: 174 (sequence of the IR-014 antibody L-chain CDR2) as CDR2, and the amino acid sequence of SEQ ID NO: 176 (sequence of the IR-014 antibody L-chain CDR3) as CDR3 of (62) is a VL comprising the amino acid sequence of SEQ ID NO: 164, more preferably, a VL comprising the amino acid sequence of SEQ ID NO: 2332 (sequence of the IR-014 antibody VL)

IR-015 antibody:
An example of the VH in the above-mentioned H chain having the amino acid sequence of SEQ ID NO: 182 (sequence of the IR-015 antibody H-chain CDR1) as CDR1, the amino acid sequence of SEQ ID NO: 184 (sequence of the IR-015 antibody H-chain CDR2) as CDR2, and the amino acid sequence of SEQ ID NO: 186 (sequence of the IR-015 antibody H-chain CDR3) as CDR3 of (67) is a VH comprising the amino acid sequence of SEQ ID NO: 2334 (sequence of the IR-015 antibody VH)

An example of the VL in the above-mentioned L chain having the amino acid sequence of SEQ ID NO: 188 (sequence of the IR-015 antibody L-chain CDR1) as CDR1, the amino acid sequence of SEQ ID NO: 190 (sequence of the IR-015 antibody L-chain CDR2) as CDR2, and the amino acid sequence of SEQ ID NO: 192 (sequence of the IR-015 antibody L-chain CDR3) as CDR3 of (68) is a VL comprising the amino acid sequence of SEQ ID NO: 180, more preferably, a VL comprising the amino acid sequence of SEQ ID NO: 2336 (sequence of the IR-015 antibody VL)

IR-017 antibody:
An example of the VH in the above-mentioned H chain having the amino acid sequence of SEQ ID NO: 198 (sequence of the IR-017 antibody H-chain CDR1) as CDR1, the amino acid sequence of SEQ ID NO: 200 (sequence of the IR-017 antibody H-chain CDR2) as CDR2, and the amino acid sequence of SEQ ID NO: 202 (sequence of the IR-017 antibody H-chain CDR3) as CDR3 of (73) is a VH comprising the amino acid sequence of SEQ ID NO: 2338 (sequence of the IR-017 antibody VH)

An example of the VL in the above-mentioned L chain having the amino acid sequence of SEQ ID NO: 204 (sequence of the IR-017 antibody L-chain CDR1) as CDR1, the amino acid sequence of SEQ ID NO: 206 (sequence of the IR-017 antibody L-chain CDR2) as CDR2, and the amino acid sequence of SEQ ID NO: 208 (sequence of the IR-017 antibody L-chain CDR3) as CDR3 of (74) is a VL comprising the amino acid sequence of SEQ ID NO: 196, more preferably, a VL comprising the amino acid sequence of SEQ ID NO: 2340 (sequence of the IR-017 antibody VL)

IR-020 antibody:
An example of the VH in the above-mentioned H chain having the amino acid sequence of SEQ ID NO: 214 (sequence of the IR-020 antibody H-chain CDR1) as CDR1, the amino acid sequence of SEQ ID NO: 216 (sequence of the IR-020 antibody H-chain CDR2) as CDR2, and the amino acid sequence of SEQ ID NO: 218 (sequence of the IR-020 antibody H-chain CDR3) as CDR3 of (79) is a VH comprising the amino acid sequence of SEQ ID NO: 2342 (sequence of the IR-020 antibody VH)

An example of the VL in the above-mentioned L chain having the amino acid sequence of SEQ ID NO: 220 (sequence of the IR-020 antibody L-chain CDR1) as CDR1, the amino acid sequence of SEQ ID NO: 222 (sequence of the IR-020 antibody L-chain CDR2) as CDR2, and the amino acid sequence of SEQ ID NO: 224 (sequence of the IR-020 antibody L-chain CDR3) as CDR3 of (80) is a VL comprising the amino acid sequence of SEQ ID NO: 212, more preferably, a VL comprising the amino acid sequence of SEQ ID NO: 2344 (sequence of the IR-020 antibody VL)

IR-021 antibody:
An example of the VH in the above-mentioned H chain having the amino acid sequence of SEQ ID NO: 230 (sequence of the IR-021 antibody H-chain CDR1) as CDR1, the amino acid sequence of SEQ ID NO: 232 (sequence of the IR-021 antibody H-chain CDR2) as CDR2, and the amino acid sequence of SEQ ID NO: 234 (sequence of the IR-021 antibody H-chain CDR3) as CDR3 of (85) is a VH comprising the amino acid sequence of SEQ ID NO: 2346 (sequence of the IR-021 antibody VH)

An example of the VL in the above-mentioned L chain having the amino acid sequence of SEQ ID NO: 236 (sequence of the IR-021 antibody L-chain CDR1) as CDR1, the amino acid sequence of SEQ ID NO: 238 (sequence of the IR-021 antibody L-chain CDR2) as CDR2, and the amino acid sequence of SEQ ID NO: 240 (sequence of the IR-021 antibody L-chain CDR3) as CDR3 of (86) is a VL comprising the amino acid sequence of SEQ ID NO: 228, more preferably, a VL comprising the amino acid sequence of SEQ ID NO: 2348 (sequence of the IR-021 antibody VL)

IR-022 antibody:
An example of the VH in the above-mentioned H chain having the amino acid sequence of SEQ ID NO: 246 (sequence of the IR-022 antibody H-chain CDR1) as CDR1, the amino acid sequence of SEQ ID NO: 248 (sequence of the IR-022 antibody H-chain CDR2) as CDR2, and the amino acid sequence of SEQ ID NO: 250 (sequence of the IR-022 antibody H-chain CDR3) as CDR3 of (91) is a VH comprising the amino acid sequence of SEQ ID NO: 2350 (sequence of the IR-022 antibody VH)

An example of the VL in the above-mentioned L chain having the amino acid sequence of SEQ ID NO: 252 (sequence of the IR-022 antibody L-chain CDR1) as CDR1, the amino acid sequence of SEQ ID NO: 254 (sequence of the IR-022 antibody L-chain CDR2) as CDR2, and the amino acid sequence of SEQ ID NO: 256 (sequence of the IR-022 antibody L-chain CDR3) as CDR3 of (92) is a VL comprising the amino acid sequence of SEQ ID NO: 244, more preferably, a VL comprising the amino acid sequence of SEQ ID NO: 2352 (sequence of the IR-022 antibody VL)

IR-023 antibody:

An example of the VH in the above-mentioned H chain having the amino acid sequence of SEQ ID NO: 262 (sequence of the IR-023 antibody H-chain CDR1) as CDR1, the amino acid sequence of SEQ ID NO: 264 (sequence of the IR-023 antibody H-chain CDR2) as CDR2, and the amino acid sequence of SEQ ID NO: 266 (sequence of the IR-023 antibody H-chain CDR3) as CDR3 of (97) is a VH comprising the amino acid sequence of SEQ ID NO: 2354 (sequence of the IR-023 antibody VH)

An example of the VL in the above-mentioned L chain having the amino acid sequence of SEQ ID NO: 268 (sequence of the IR-023 antibody L-chain CDR1) as CDR1, the amino acid sequence of SEQ ID NO: 270 (sequence of the IR-023 antibody L-chain CDR2) as CDR2, and the amino acid sequence of SEQ ID NO: 272 (sequence of the IR-023 antibody L-chain CDR3) as CDR3 of (98) is a VL comprising the amino acid sequence of SEQ ID NO: 260, more preferably, a VL comprising the amino acid sequence of SEQ ID NO: 2356 (sequence of the IR-023 antibody VL)

IR-024 antibody:

An example of the VH in the above-mentioned H chain having the amino acid sequence of SEQ ID NO: 278 (sequence of the IR-024 antibody H-chain CDR1) as CDR1, the amino acid sequence of SEQ ID NO: 280 (sequence of the IR-024 antibody H-chain CDR2) as CDR2, and the amino acid sequence of SEQ ID NO: 282 (sequence of the IR-024 antibody H-chain CDR3) as CDR3 of (103) is a VH comprising the amino acid sequence of SEQ ID NO: 2358 (sequence of the IR-024 antibody VH)

An example of the VL in the above-mentioned L chain having the amino acid sequence of SEQ ID NO: 284 (sequence of the IR-024 antibody L-chain CDR1) as CDR1, the amino acid sequence of SEQ ID NO: 286 (sequence of the IR-024 antibody L-chain CDR2) as CDR2, and the amino acid sequence of SEQ ID NO: 288 (sequence of the IR-024 antibody L-chain CDR3) as CDR3 of (104) is a VL comprising the amino acid sequence of SEQ ID NO: 276, more preferably, a VL comprising the amino acid sequence of SEQ ID NO: 2360 (sequence of the IR-024 antibody VL)

IR-025 antibody:

An example of the VH in the above-mentioned H chain having the amino acid sequence of SEQ ID NO: 294 (sequence of the IR-025 antibody H-chain CDR1) as CDR1, the amino acid sequence of SEQ ID NO: 296 (sequence of the IR-025 antibody H-chain CDR2) as CDR2, and the amino acid sequence of SEQ ID NO: 298 (sequence of the IR-025 antibody H-chain CDR3) as CDR3 of (109) is a VH comprising the amino acid sequence of SEQ ID NO: 2362 (sequence of the IR-025 antibody VH)

An example of the VL in the above-mentioned L chain having the amino acid sequence of SEQ ID NO: 300 (sequence of the IR-025 antibody L-chain CDR1) as CDR1, the amino acid sequence of SEQ ID NO: 302 (sequence of the IR-025 antibody L-chain CDR2) as CDR2, and the amino acid sequence of SEQ ID NO: 304 (sequence of the IR-025 antibody L-chain CDR3) as CDR3 of (110) is a VL comprising the amino acid sequence of SEQ ID NO: 292, more preferably, a VL comprising the amino acid sequence of SEQ ID NO: 2364 (sequence of the IR-025 antibody VL)

IR-026 antibody:

An example of the VH in the above-mentioned H chain having the amino acid sequence of SEQ ID NO: 310 (sequence of the IR-026 antibody H-chain CDR1) as CDR1, the amino acid sequence of SEQ ID NO: 312 (sequence of the IR-026 antibody H-chain CDR2) as CDR2, and the amino acid sequence of SEQ ID NO: 314 (sequence of the IR-026 antibody H-chain CDR3) as CDR3 of (115) is a VH comprising the amino acid sequence of SEQ ID NO: 2366 (sequence of the IR-026 antibody VH)

An example of the VL in the above-mentioned L chain having the amino acid sequence of SEQ ID NO: 316 (sequence of the IR-026 antibody L-chain CDR1) as CDR1, the amino acid sequence of SEQ ID NO: 318 (sequence of the IR-026 antibody L-chain CDR2) as CDR2, and the amino acid sequence of SEQ ID NO: 320 (sequence of the IR-026 antibody L-chain CDR3) as CDR3 of (116) is a VL comprising the amino acid sequence of SEQ ID NO: 308, more preferably, a VL comprising the amino acid sequence of SEQ ID NO: 2368 (sequence of the IR-026 antibody VL)

IR-027 antibody:

An example of the VH in the above-mentioned H chain having the amino acid sequence of SEQ ID NO: 326 (sequence of the IR-027 antibody H-chain CDR1) as CDR1, the amino acid sequence of SEQ ID NO: 328 (sequence of the IR-027 antibody H-chain CDR2) as CDR2, and the amino acid sequence of SEQ ID NO: 330 (sequence of the IR-027 antibody H-chain CDR3) as CDR3 of (121) is a VH comprising the amino acid sequence of SEQ ID NO: 2370 (sequence of the IR-027 antibody VH)

An example of the VL in the above-mentioned L chain having the amino acid sequence of SEQ ID NO: 332 (sequence of the IR-027 antibody L-chain CDR1) as CDR1, the amino acid sequence of SEQ ID NO: 334 (sequence of the IR-027 antibody L-chain CDR2) as CDR2, and the amino acid sequence of SEQ ID NO: 336 (sequence of the IR-027 antibody L-chain CDR3) as CDR3 of (122) is a VL comprising the amino acid sequence of SEQ ID NO: 324, more preferably, a VL comprising the amino acid sequence of SEQ ID NO: 2372 (sequence of the IR-027 antibody VL)

IR-028 antibody:

An example of the VH in the above-mentioned H chain having the amino acid sequence of SEQ ID NO: 342 (sequence of the IR-028 antibody H-chain CDR1) as CDR1, the amino acid sequence of SEQ ID NO: 344 (sequence of the IR-028 antibody H-chain CDR2) as CDR2, and the amino acid sequence of SEQ ID NO: 346 (sequence of the IR-028 antibody H-chain CDR3) as CDR3 of (127) is a VH comprising the amino acid sequence of SEQ ID NO: 2374 (sequence of the IR-028 antibody VH)

An example of the VL in the above-mentioned L chain having the amino acid sequence of SEQ ID NO: 348 (sequence of the IR-028 antibody L-chain CDR1) as CDR1, the amino acid sequence of SEQ ID NO: 350 (sequence of the IR-028 antibody L-chain CDR2) as CDR2, and the amino acid sequence of SEQ ID NO: 352 (sequence of the IR-028 antibody L-chain CDR3) as CDR3 of (128) is a VL comprising the amino acid sequence of SEQ ID NO: 340, more preferably, a VL comprising the amino acid sequence of SEQ ID NO: 2376 (sequence of the IR-028 antibody VL)

IR-029 antibody:

An example of the VH in the above-mentioned H chain having the amino acid sequence of SEQ ID NO: 358 (sequence of the IR-029 antibody H-chain CDR1) as CDR1, the amino acid sequence of SEQ ID NO: 360 (sequence of the IR-029 antibody H-chain CDR2) as CDR2, and the amino acid sequence of SEQ ID NO: 362 (sequence of the IR-029 antibody H-chain CDR3) as CDR3 of (133) is a VH comprising the amino acid sequence of SEQ ID NO: 2378 (sequence of the IR-029 antibody VH)

An example of the VL in the above-mentioned L chain having the amino acid sequence of SEQ ID NO: 364 (sequence of the IR-029 antibody L-chain CDR1) as CDR1, the amino acid sequence of SEQ ID NO: 366 (sequence of the IR-029 antibody L-chain CDR2) as CDR2, and the amino acid sequence of SEQ ID NO: 368 (sequence of the IR-029 antibody L-chain CDR3) as CDR3 of (134) is a VL comprising the amino acid sequence of SEQ ID NO: 356, more preferably, a VL comprising the amino acid sequence of SEQ ID NO: 2380 (sequence of the IR-029 antibody VL)

IR-030 antibody:

An example of the VH in the above-mentioned H chain having the amino acid sequence of SEQ ID NO: 374 (sequence of the IR-030 antibody H-chain CDR1) as CDR1, the amino acid sequence of SEQ ID NO: 376 (sequence of the IR-030 antibody H-chain CDR2) as CDR2, and the amino acid sequence of SEQ ID NO: 378 (sequence of the IR-030 antibody H-chain CDR3) as CDR3 of (139) is a VH comprising the amino acid sequence of SEQ ID NO: 2382 (sequence of the IR-030 antibody VH)

An example of the VL in the above-mentioned L chain having the amino acid sequence of SEQ ID NO: 380 (sequence of the IR-030 antibody L-chain CDR1) as CDR1, the amino acid sequence of SEQ ID NO: 382 (sequence of the IR-030 antibody L-chain CDR2) as CDR2, and the amino acid sequence of SEQ ID NO: 384 (sequence of the IR-030 antibody L-chain CDR3) as CDR3 of (140) is a VL comprising the amino acid sequence of SEQ ID NO: 372, more preferably, a VL comprising the amino acid sequence of SEQ ID NO: 2384 (sequence of the IR-030 antibody VL)

IR-031 antibody:

An example of the VH in the above-mentioned H chain having the amino acid sequence of SEQ ID NO: 390 (sequence of the IR-031 antibody H-chain CDR1) as CDR1, the amino acid sequence of SEQ ID NO: 392 (sequence of the IR-031 antibody H-chain CDR2) as CDR2, and the amino acid sequence of SEQ ID NO: 394 (sequence of the IR-031 antibody H-chain CDR3) as CDR3 of (145) is a VH comprising the amino acid sequence of SEQ ID NO: 2386 (sequence of the IR-031 antibody VH)

An example of the VL in the above-mentioned L chain having the amino acid sequence of SEQ ID NO: 396 (sequence of the IR-031 antibody L-chain CDR1) as CDR1, the amino acid sequence of SEQ ID NO: 398 (sequence of the IR-031 antibody L-chain CDR2) as CDR2, and the amino acid sequence of SEQ ID NO: 400 (sequence of the IR-031 antibody L-chain CDR3) as CDR3 of (146) is a VL comprising the amino acid sequence of SEQ ID NO: 388, more preferably, a VL comprising the amino acid sequence of SEQ ID NO: 2388 (sequence of the IR-031 antibody VL)

IR-032 antibody:

An example of the VH in the above-mentioned H chain having the amino acid sequence of SEQ ID NO: 406 (sequence of the IR-032 antibody H-chain CDR1) as CDR1, the amino acid sequence of SEQ ID NO: 408 (sequence of the IR-032 antibody H-chain CDR2) as CDR2, and the amino acid sequence of SEQ ID NO: 410 (sequence of the IR-032 antibody H-chain CDR3) as CDR3 of (151) is a VH comprising the amino acid sequence of SEQ ID NO: 2390 (sequence of the IR-032 antibody VH)

An example of the VL in the above-mentioned L chain having the amino acid sequence of SEQ ID NO: 412 (sequence of the IR-032 antibody L-chain CDR1) as CDR1, the amino acid sequence of SEQ ID NO: 414 (sequence of the IR-032 antibody L-chain CDR2) as CDR2, and the amino acid sequence of SEQ ID NO: 416 (sequence of the IR-032 antibody L-chain CDR3) as CDR3 of (152) is a VL comprising the amino acid sequence of SEQ ID NO: 404, more preferably, a VL comprising the amino acid sequence of SEQ ID NO: 2392 (sequence of the IR-032 antibody VL)

IR-033 antibody:

An example of the VH in the above-mentioned H chain having the amino acid sequence of SEQ ID NO: 422 (sequence of the IR-033 antibody H-chain CDR1) as CDR1, the amino acid sequence of SEQ ID NO: 424 (sequence of the IR-033 antibody H-chain CDR2) as CDR2, and the amino acid sequence of SEQ ID NO: 426 (sequence of the IR-033 antibody H-chain CDR3) as CDR3 of (157) is a VH comprising the amino acid sequence of SEQ ID NO: 418, more preferably, a VH comprising the amino acid sequence of SEQ ID NO: 2394 (sequence of the IR-033 antibody VH)

An example of the VL in the above-mentioned L chain having the amino acid sequence of SEQ ID NO: 428 (sequence of the IR-033 antibody L-chain CDR1) as CDR1, the amino acid sequence of SEQ ID NO: 430 (sequence of the IR-033 antibody L-chain CDR2) as CDR2, and the amino acid sequence of SEQ ID NO: 432 (sequence of the IR-033 antibody L-chain CDR3) as CDR3 of (158) is a VL comprising the amino acid sequence of SEQ ID NO: 420, more preferably, a VL comprising the amino acid sequence of SEQ ID NO: 2396 (sequence of the IR-033 antibody VL)

IR-034 antibody:

An example of the VH in the above-mentioned H chain having the amino acid sequence of SEQ ID NO: 438 (sequence of the IR-034 antibody H-chain CDR1) as CDR1, the amino acid sequence of SEQ ID NO: 440 (sequence of the IR-034 antibody H-chain CDR2) as CDR2, and the amino acid sequence of SEQ ID NO: 442 (sequence of the IR-034 antibody H-chain CDR3) as CDR3 of (163) is a VH comprising the amino acid sequence of SEQ ID NO: 2398 (sequence of the IR-034 antibody VH)

An example of the VL in the above-mentioned L chain having the amino acid sequence of SEQ ID NO: 444 (sequence of the IR-034 antibody L-chain CDR1) as CDR1, the amino acid sequence of SEQ ID NO: 446 (sequence of the IR-034 antibody L-chain CDR2) as CDR2, and the amino acid sequence of SEQ ID NO: 448 (sequence of the IR-034 antibody L-chain CDR3) as CDR3 of (164) is a VL comprising the amino acid sequence of SEQ ID NO: 436, more preferably, a VL comprising the amino acid sequence of SEQ ID NO: 2400 (sequence of the IR-034 antibody VL)

IR-035 antibody:

An example of the VH in the above-mentioned H chain having the amino acid sequence of SEQ ID NO: 454 (sequence of the IR-035 antibody H-chain CDR1) as CDR1, the amino acid sequence of SEQ ID NO: 456 (sequence of the IR-035 antibody H-chain CDR2) as CDR2, and the amino acid sequence of SEQ ID NO: 458 (sequence of the IR-035 antibody H-chain CDR3) as CDR3 of (169) is a VH comprising the amino acid sequence of SEQ ID NO: 2402 (sequence of the IR-035 antibody VH)

An example of the VL in the above-mentioned L chain having the amino acid sequence of SEQ ID NO: 460 (sequence of the IR-035 antibody L-chain CDR1) as CDR1, the amino acid sequence of SEQ ID NO: 462 (sequence of the IR-035 antibody L-chain CDR2) as CDR2, and the amino acid sequence of SEQ ID NO: 464 (sequence of the IR-035 antibody L-chain CDR3) as CDR3 of (170) is a VL comprising the amino acid sequence of SEQ ID NO: 452, more preferably, a VL comprising the amino acid sequence of SEQ ID NO: 2404 (sequence of the IR-035 antibody VL)

IR-036 antibody:
An example of the VH in the above-mentioned H chain having the amino acid sequence of SEQ ID NO: 470 (sequence of the IR-036 antibody H-chain CDR1) as CDR1, the amino acid sequence of SEQ ID NO: 472 (sequence of the IR-036 antibody H-chain CDR2) as CDR2, and the amino acid sequence of SEQ ID NO: 474 (sequence of the IR-036 antibody H-chain CDR3) as CDR3 of (175) is a VH comprising the amino acid sequence of SEQ ID NO: 2406 (sequence of the IR-036 antibody VH)

An example of the VL in the above-mentioned L chain having the amino acid sequence of SEQ ID NO: 476 (sequence of the IR-036 antibody L-chain CDR1) as CDR1, the amino acid sequence of SEQ ID NO: 478 (sequence of the IR-036 antibody L-chain CDR2) as CDR2, and the amino acid sequence of SEQ ID NO: 480 (sequence of the IR-036 antibody L-chain CDR3) as CDR3 of (176) is a VL comprising the amino acid sequence of SEQ ID NO: 468, more preferably, a VL comprising the amino acid sequence of SEQ ID NO: 2408 (sequence of the IR-036 antibody VL)

IR-037 antibody:
An example of the VH in the above-mentioned H chain having the amino acid sequence of SEQ ID NO: 486 (sequence of the IR-037 antibody H-chain CDR1) as CDR1, the amino acid sequence of SEQ ID NO: 488 (sequence of the IR-037 antibody H-chain CDR2) as CDR2, and the amino acid sequence of SEQ ID NO: 490 (sequence of the IR-037 antibody H-chain CDR3) as CDR3 of (181) is a VH comprising the amino acid sequence of SEQ ID NO: 2410 (sequence of the IR-037 antibody VH)

An example of the VL in the above-mentioned L chain having the amino acid sequence of SEQ ID NO: 492 (sequence of the IR-037 antibody L-chain CDR1) as CDR1, the amino acid sequence of SEQ ID NO: 494 (sequence of the IR-037 antibody L-chain CDR2) as CDR2, and the amino acid sequence of SEQ ID NO: 496 (sequence of the IR-037 antibody L-chain CDR3) as CDR3 of (182) is a VL comprising the amino acid sequence of SEQ ID NO: 484, more preferably, a VL comprising the amino acid sequence of SEQ ID NO: 2412 (sequence of the IR-037 antibody VL)

IR-038 antibody:
An example of the VH in the above-mentioned H chain having the amino acid sequence of SEQ ID NO: 502 (sequence of the IR-038 antibody H-chain CDR1) as CDR1, the amino acid sequence of SEQ ID NO: 504 (sequence of the IR-038 antibody H-chain CDR2) as CDR2, and the amino acid sequence of SEQ ID NO: 506 (sequence of the IR-038 antibody H-chain CDR3) as CDR3 of (187) is a VH comprising the amino acid sequence of SEQ ID NO: 2414 (sequence of the IR-038 antibody VH)

An example of the VL in the above-mentioned L chain having the amino acid sequence of SEQ ID NO: 508 (sequence of the IR-038 antibody L-chain CDR1) as CDR1, the amino acid sequence of SEQ ID NO: 510 (sequence of the IR-038 antibody L-chain CDR2) as CDR2, and the amino acid sequence of SEQ ID NO: 512 (sequence of the IR-038 antibody L-chain CDR3) as CDR3 of (188) is a VL comprising the amino acid sequence of SEQ ID NO: 500, more preferably, a VL comprising the amino acid sequence of SEQ ID NO: 2416 (sequence of the IR-038 antibody VL)

IR-039 antibody:
An example of the VH in the above-mentioned H chain having the amino acid sequence of SEQ ID NO: 518 (sequence of the IR-039 antibody H-chain CDR1) as CDR1, the amino acid sequence of SEQ ID NO: 520 (sequence of the IR-039 antibody H-chain CDR2) as CDR2, and the amino acid sequence of SEQ ID NO: 522 (sequence of the IR-039 antibody H-chain CDR3) as CDR3 of (193) is a VH comprising the amino acid sequence of SEQ ID NO: 2418 (sequence of the IR-039 antibody VH)

An example of the VL in the above-mentioned L chain having the amino acid sequence of SEQ ID NO: 524 (sequence of the IR-039 antibody L-chain CDR1) as CDR1, the amino acid sequence of SEQ ID NO: 526 (sequence of the IR-039 antibody L-chain CDR2) as CDR2, and the amino acid sequence of SEQ ID NO: 528 (sequence of the IR-039 antibody L-chain CDR3) as CDR3 of (194) is a VL comprising the amino acid sequence of SEQ ID NO: 516, more preferably, a VL comprising the amino acid sequence of SEQ ID NO: 2420 (sequence of the IR-039 antibody VL)

IR-040 antibody:
An example of the VH in the above-mentioned H chain having the amino acid sequence of SEQ ID NO: 534 (sequence of the IR-040 antibody H-chain CDR1) as CDR1, the amino acid sequence of SEQ ID NO: 536 (sequence of the IR-040 antibody H-chain CDR2) as CDR2, and the amino acid sequence of SEQ ID NO: 538 (sequence of the IR-040 antibody H-chain CDR3) as CDR3 of (199) is a VH comprising the amino acid sequence of SEQ ID NO: 2422 (sequence of the IR-040 antibody VH)

An example of the VL in the above-mentioned L chain having the amino acid sequence of SEQ ID NO: 540 (sequence of the IR-040 antibody L-chain CDR1) as CDR1, the amino acid sequence of SEQ ID NO: 542 (sequence of the IR-040 antibody L-chain CDR2) as CDR2, and the amino acid sequence of SEQ ID NO: 544 (sequence of the IR-040 antibody L-chain CDR3) as CDR3 of (200) is a VL comprising the amino acid sequence of SEQ ID NO: 532, more preferably, a VL comprising the amino acid sequence of SEQ ID NO: 2424 (sequence of the IR-040 antibody VL)

IR-041 antibody:
An example of the VH in the above-mentioned H chain having the amino acid sequence of SEQ ID NO: 550 (sequence of the IR-041 antibody H-chain CDR1) as CDR1, the amino acid sequence of SEQ ID NO: 552 (sequence of the IR-041 antibody H-chain CDR2) as CDR2, and the amino acid sequence of SEQ ID NO: 554 (sequence of the IR-041 antibody H-chain CDR3) as CDR3 of (205) is a VH comprising the amino acid sequence of SEQ ID NO: 2426 (sequence of the IR-041 antibody VH)

An example of the VL in the above-mentioned L chain having the amino acid sequence of SEQ ID NO: 556 (sequence of the IR-041 antibody L-chain CDR1) as CDR1, the amino acid sequence of SEQ ID NO: 558 (sequence of the IR-041 antibody L-chain CDR2) as CDR2, and the amino acid sequence of SEQ ID NO: 560 (sequence of the IR-041 antibody L-chain CDR3) as CDR3 of (206) is a VL comprising the amino acid sequence of SEQ ID NO: 548, more preferably, a VL comprising the amino acid sequence of SEQ ID NO: 2428 (sequence of the IR-041 antibody VL)

IR-043 antibody:
An example of the VH in the above-mentioned H chain having the amino acid sequence of SEQ ID NO: 566 (sequence of the IR-043 antibody H-chain CDR1) as CDR1, the amino acid sequence of SEQ ID NO: 568 (sequence of the IR-043 antibody H-chain CDR2) as CDR2, and the amino acid sequence of SEQ ID NO: 570 (sequence of the IR-043 antibody H-chain CDR3) as CDR3 of (211) is a VH comprising the amino acid sequence of SEQ ID NO: 2430 (sequence of the IR-043 antibody VH)

An example of the VL in the above-mentioned L chain having the amino acid sequence of SEQ ID NO: 572 (sequence of the IR-043 antibody L-chain CDR1) as CDR1, the amino acid sequence of SEQ ID NO: 574 (sequence of the IR-043 antibody L-chain CDR2) as CDR2, and the amino acid sequence of SEQ ID NO: 576 (sequence of the IR-043 antibody L-chain CDR3) as CDR3 of (212) is a VL comprising the amino acid sequence of SEQ ID NO: 564, more preferably, a VL comprising the amino acid sequence of SEQ ID NO: 2432 (sequence of the IR-043 antibody VL)

IR-044 antibody:

An example of the VH in the above-mentioned H chain having the amino acid sequence of SEQ ID NO: 582 (sequence of the IR-044 antibody H-chain CDR1) as CDR1, the amino acid sequence of SEQ ID NO: 584 (sequence of the IR-044 antibody H-chain CDR2) as CDR2, and the amino acid sequence of SEQ ID NO: 586 (sequence of the IR-044 antibody H-chain CDR3) as CDR3 of (217) is a VH comprising the amino acid sequence of SEQ ID NO: 2434 (sequence of the IR-044 antibody VH)

An example of the VL in the above-mentioned L chain having the amino acid sequence of SEQ ID NO: 588 (sequence of the IR-044 antibody L-chain CDR1) as CDR1, the amino acid sequence of SEQ ID NO: 590 (sequence of the IR-044 antibody L-chain CDR2) as CDR2, and the amino acid sequence of SEQ ID NO: 592 (sequence of the IR-044 antibody L-chain CDR3) as CDR3 of (218) is a VL comprising the amino acid sequence of SEQ ID NO: 580, more preferably, a VL comprising the amino acid sequence of SEQ ID NO: 2436 (sequence of the IR-044 antibody VL)

IR-045 antibody:

An example of the VH in the above-mentioned H chain having the amino acid sequence of SEQ ID NO: 598 (sequence of the IR-045 antibody H-chain CDR1) as CDR1, the amino acid sequence of SEQ ID NO: 600 (sequence of the IR-045 antibody H-chain CDR2) as CDR2, and the amino acid sequence of SEQ ID NO: 602 (sequence of the IR-045 antibody H-chain CDR3) as CDR3 of (223) is a VH comprising the amino acid sequence of SEQ ID NO: 2438 (sequence of the IR-045 antibody VH)

An example of the VL in the above-mentioned L chain having the amino acid sequence of SEQ ID NO: 604 (sequence of the IR-045 antibody L-chain CDR1) as CDR1, the amino acid sequence of SEQ ID NO: 606 (sequence of the IR-045 antibody L-chain CDR2) as CDR2, and the amino acid sequence of SEQ ID NO: 608 (sequence of the IR-045 antibody L-chain CDR3) as CDR3 of (224) is a VL comprising the amino acid sequence of SEQ ID NO: 596, more preferably, a VL comprising the amino acid sequence of SEQ ID NO: 2440 (sequence of the IR-045 antibody VL)

IR-046 antibody:

An example of the VH in the above-mentioned H chain having the amino acid sequence of SEQ ID NO: 614 (sequence of the IR-046 antibody H-chain CDR1) as CDR1, the amino acid sequence of SEQ ID NO: 616 (sequence of the IR-046 antibody H-chain CDR2) as CDR2, and the amino acid sequence of SEQ ID NO: 618 (sequence of the IR-046 antibody H-chain CDR3) as CDR3 of (229) is a VH comprising the amino acid sequence of SEQ ID NO: 2442 (sequence of the IR-046 antibody VH)

An example of the VL in the above-mentioned L chain having the amino acid sequence of SEQ ID NO: 620 (sequence of the IR-046 antibody L-chain CDR1) as CDR1, the amino acid sequence of SEQ ID NO: 622 (sequence of the IR-046 antibody L-chain CDR2) as CDR2, and the amino acid sequence of SEQ ID NO: 624 (sequence of the IR-046 antibody L-chain CDR3) as CDR3 of (230) is a VL comprising the amino acid sequence of SEQ ID NO: 612, more preferably, a VL comprising the amino acid sequence of SEQ ID NO: 2444 (sequence of the IR-046 antibody VL)

IR-048 antibody:

An example of the VH in the above-mentioned H chain having the amino acid sequence of SEQ ID NO: 630 (sequence of the IR-048 antibody H-chain CDR1) as CDR1, the amino acid sequence of SEQ ID NO: 632 (sequence of the IR-048 antibody H-chain CDR2) as CDR2, and the amino acid sequence of SEQ ID NO: 634 (sequence of the IR-048 antibody H-chain CDR3) as CDR3 of (235) is a VH comprising the amino acid sequence of SEQ ID NO: 2446 (sequence of the IR-048 antibody VH)

An example of the VL in the above-mentioned L chain having the amino acid sequence of SEQ ID NO: 636 (sequence of the IR-048 antibody L-chain CDR1) as CDR1, the amino acid sequence of SEQ ID NO: 638 (sequence of the IR-048 antibody L-chain CDR2) as CDR2, and the amino acid sequence of SEQ ID NO: 640 (sequence of the IR-048 antibody L-chain CDR3) as CDR3 of (236) is a VL comprising the amino acid sequence of SEQ ID NO: 628, more preferably, a VL comprising the amino acid sequence of SEQ ID NO: 2448 (sequence of the IR-048 antibody VL)

IR-049 antibody:

An example of the VH in the above-mentioned H chain having the amino acid sequence of SEQ ID NO: 646 (sequence of the IR-049 antibody H-chain CDR1) as CDR1, the amino acid sequence of SEQ ID NO: 648 (sequence of the IR-049 antibody H-chain CDR2) as CDR2, and the amino acid sequence of SEQ ID NO: 650 (sequence of the IR-049 antibody H-chain CDR3) as CDR3 of (241) is a VH comprising the amino acid sequence of SEQ ID NO: 2450 (sequence of the IR-049 antibody VH)

An example of the VL in the above-mentioned L chain having the amino acid sequence of SEQ ID NO: 652 (sequence of the IR-049 antibody L-chain CDR1) as CDR1, the amino acid sequence of SEQ ID NO: 654 (sequence of the IR-049 antibody L-chain CDR2) as CDR2, and the amino acid sequence of SEQ ID NO: 656 (sequence of the IR-049 antibody L-chain CDR3) as CDR3 of (242) is a VL comprising the amino acid sequence of SEQ ID NO: 644, more preferably, a VL comprising the amino acid sequence of SEQ ID NO: 2452 (sequence of the IR-049 antibody VL)

IR-050 antibody:

An example of the VH in the above-mentioned H chain having the amino acid sequence of SEQ ID NO: 662 (sequence of the IR-050 antibody H-chain CDR1) as CDR1, the amino acid sequence of SEQ ID NO: 664 (sequence of the IR-050 antibody H-chain CDR2) as CDR2, and the amino acid sequence of SEQ ID NO: 666 (sequence of the IR-050 antibody H-chain CDR3) as CDR3 of (247) is a VH comprising the amino acid sequence of SEQ ID NO: 2454 (sequence of the IR-050 antibody VH)

An example of the VL in the above-mentioned L chain having the amino acid sequence of SEQ ID NO: 668 (sequence of the IR-050 antibody L-chain CDR1) as CDR1, the amino acid sequence of SEQ ID NO: 670 (sequence of the IR-050 antibody L-chain CDR2) as CDR2, and the amino acid sequence of SEQ ID NO: 672 (sequence of the IR-050 antibody L-chain CDR3) as CDR3 of (248) is a VL comprising the amino acid sequence of SEQ ID NO: 660, more preferably, a VL comprising the amino acid sequence of SEQ ID NO: 2456 (sequence of the IR-050 antibody VL)

IR-051 antibody:

An example of the VH in the above-mentioned H chain having the amino acid sequence of SEQ ID NO: 678 (sequence of the IR-051 antibody H-chain CDR1) as CDR1, the amino acid sequence of SEQ ID NO: 680 (sequence of the IR-051 antibody H-chain CDR2) as CDR2, and the amino acid sequence of SEQ ID NO: 682 (sequence of the IR-051 antibody H-chain CDR3) as CDR3 of (253) is a VH comprising the amino acid sequence of SEQ ID NO: 2458 (sequence of the IR-051 antibody VH)

An example of the VL in the above-mentioned L chain having the amino acid sequence of SEQ ID NO: 684 (sequence of the IR-051 antibody L-chain CDR1) as CDR1, the amino acid sequence of SEQ ID NO: 686 (sequence of the IR-051 antibody L-chain CDR2) as CDR2, and the amino acid sequence of SEQ ID NO: 688 (sequence of the IR-051 antibody L-chain CDR3) as CDR3 of (254) is a VL comprising the amino acid sequence of SEQ ID NO: 676, more preferably, a VL comprising the amino acid sequence of SEQ ID NO: 2460 (sequence of the IR-051 antibody VL)

IR-052 antibody:

An example of the VH in the above-mentioned H chain having the amino acid sequence of SEQ ID NO: 694 (sequence of the IR-052 antibody H-chain CDR1) as CDR1, the amino acid sequence of SEQ ID NO: 696 (sequence of the IR-052 antibody H-chain CDR2) as CDR2, and the amino acid sequence of SEQ ID NO: 698 (sequence of the IR-052 antibody H-chain CDR3) as CDR3 of (259) is a VH comprising the amino acid sequence of SEQ ID NO: 2462 (sequence of the IR-052 antibody VH)

An example of the VL in the above-mentioned L chain having the amino acid sequence of SEQ ID NO: 700 (sequence of the IR-052 antibody L-chain CDR1) as CDR1, the amino acid sequence of SEQ ID NO: 702 (sequence of the IR-052 antibody L-chain CDR2) as CDR2, and the amino acid sequence of SEQ ID NO: 704 (sequence of the IR-052 antibody L-chain CDR3) as CDR3 of (260) is a VL comprising the amino acid sequence of SEQ ID NO: 692, more preferably, a VL comprising the amino acid sequence of SEQ ID NO: 2464 (sequence of the IR-052 antibody VL)

IR-053 antibody:

An example of the VH in the above-mentioned H chain having the amino acid sequence of SEQ ID NO: 710 (sequence of the IR-053 antibody H-chain CDR1) as CDR1, the amino acid sequence of SEQ ID NO: 712 (sequence of the IR-053 antibody H-chain CDR2) as CDR2, and the amino acid sequence of SEQ ID NO: 714 (sequence of the IR-053 antibody H-chain CDR3) as CDR3 of (265) is a VH comprising the amino acid sequence of SEQ ID NO: 2466 (sequence of the IR-053 antibody VH)

An example of the VL in the above-mentioned L chain having the amino acid sequence of SEQ ID NO: 716 (sequence of the IR-053 antibody L-chain CDR1) as CDR1, the amino acid sequence of SEQ ID NO: 718 (sequence of the IR-053 antibody L-chain CDR2) as CDR2, and the amino acid sequence of SEQ ID NO: 720 (sequence of the IR-053 antibody L-chain CDR3) as CDR3 of (266) is a VL comprising the amino acid sequence of SEQ ID NO: 708, more preferably, a VL comprising the amino acid sequence of SEQ ID NO: 2468 (sequence of the IR-053 antibody VL)

IR-054 antibody:

An example of the VH in the above-mentioned H chain having the amino acid sequence of SEQ ID NO: 726 (sequence of the IR-054 antibody H-chain CDR1) as CDR1, the amino acid sequence of SEQ ID NO: 728 (sequence of the IR-054 antibody H-chain CDR2) as CDR2, and the amino acid sequence of SEQ ID NO: 730 (sequence of the IR-054 antibody H-chain CDR3) as CDR3 of (271) is a VH comprising the amino acid sequence of SEQ ID NO: 2470 (sequence of the IR-054 antibody VH)

An example of the VL in the above-mentioned L chain having the amino acid sequence of SEQ ID NO: 732 (sequence of the IR-054 antibody L-chain CDR1) as CDR1, the amino acid sequence of SEQ ID NO: 734 (sequence of the IR-054 antibody L-chain CDR2) as CDR2, and the amino acid sequence of SEQ ID NO: 736 (sequence of the IR-054 antibody L-chain CDR3) as CDR3 of (272) is a VL comprising the amino acid sequence of SEQ ID NO: 2472 (sequence of the IR-054 antibody VL)

IR-055 antibody:

An example of the VH in the above-mentioned H chain having the amino acid sequence of SEQ ID NO: 742 (sequence of the IR-055 antibody H-chain CDR1) as CDR1, the amino acid sequence of SEQ ID NO: 744 (sequence of the IR-055 antibody H-chain CDR2) as CDR2, and the amino acid sequence of SEQ ID NO: 746 (sequence of the IR-055 antibody H-chain CDR3) as CDR3 of (277) is a VH comprising the amino acid sequence of SEQ ID NO: 2474 (sequence of the IR-055 antibody VH)

An example of the VL in the above-mentioned L chain having the amino acid sequence of SEQ ID NO: 748 (sequence of the IR-055 antibody L-chain CDR1) as CDR1, the amino acid sequence of SEQ ID NO: 750 (sequence of the IR-055 antibody L-chain CDR2) as CDR2, and the amino acid sequence of SEQ ID NO: 752 (sequence of the IR-055 antibody L-chain CDR3) as CDR3 of (278) is a VL comprising the amino acid sequence of SEQ ID NO: 740, more preferably, a VL comprising the amino acid sequence of SEQ ID NO: 2476 (sequence of the IR-055 antibody VL)

IR-056 antibody:

An example of the VH in the above-mentioned H chain having the amino acid sequence of SEQ ID NO: 758 (sequence of the IR-056 antibody H-chain CDR1) as CDR1, the amino acid sequence of SEQ ID NO: 760 (sequence of the IR-056 antibody H-chain CDR2) as CDR2, and the amino acid sequence of SEQ ID NO: 762 (sequence of the IR-056 antibody H-chain CDR3) as CDR3 of (283) is a VH comprising the amino acid sequence of SEQ ID NO: 2478 (sequence of the IR-056 antibody VH)

An example of the VL in the above-mentioned L chain having the amino acid sequence of SEQ ID NO: 764 (sequence of the IR-056 antibody L-chain CDR1) as CDR1, the amino acid sequence of SEQ ID NO: 766 (sequence of the IR-056 antibody L-chain CDR2) as CDR2, and the amino acid sequence of SEQ ID NO: 768 (sequence of the IR-056 antibody L-chain CDR3) as CDR3 of (284) is a VL comprising the amino acid sequence of SEQ ID NO: 756, more preferably, a VL comprising the amino acid sequence of SEQ ID NO: 2480 (sequence of the IR-056 antibody VL)

IR-057 antibody:

An example of the VH in the above-mentioned H chain having the amino acid sequence of SEQ ID NO: 774 (sequence of the IR-057 antibody H-chain CDR1) as CDR1, the amino acid sequence of SEQ ID NO: 776 (sequence of the IR-057 antibody H-chain CDR2) as CDR2, and the amino acid sequence of SEQ ID NO: 778 (sequence of the IR-057 antibody H-chain CDR3) as CDR3 of (289) is a VH comprising the amino acid sequence of SEQ ID NO: 2482 (sequence of the IR-057 antibody VH)

An example of the VL in the above-mentioned L chain having the amino acid sequence of SEQ ID NO: 780 (sequence of the IR-057 antibody L-chain CDR1) as CDR1, the amino acid sequence of SEQ ID NO: 782 (sequence of the IR-057 antibody L-chain CDR2) as CDR2, and the amino acid sequence of SEQ ID NO: 784 (sequence of the IR-057 antibody L-chain CDR3) as CDR3 of (290) is a VL comprising the amino acid sequence of SEQ ID NO: 772, more preferably, a VL comprising the amino acid sequence of SEQ ID NO: 2484 (sequence of the IR-057 antibody VL)

IR-058 antibody:

An example of the VH in the above-mentioned H chain having the amino acid sequence of SEQ ID NO: 790 (sequence of the IR-058 antibody H-chain CDR1) as CDR1, the amino acid sequence of SEQ ID NO: 792 (sequence of the IR-058 antibody H-chain CDR2) as CDR2, and the amino acid sequence of SEQ ID NO: 794 (sequence of the IR-058 antibody H-chain CDR3) as CDR3 of (295) is a VH comprising the amino acid sequence of SEQ ID NO: 2486 (sequence of the IR-058 antibody VH)

An example of the VL in the above-mentioned L chain having the amino acid sequence of SEQ ID NO: 796 (sequence of the IR-058 antibody L-chain CDR1) as CDR1, the amino acid sequence of SEQ ID NO: 798 (sequence of the IR-058 antibody L-chain CDR2) as CDR2, and the amino acid sequence of SEQ ID NO: 800 (sequence of the IR-058 antibody L-chain CDR3) as CDR3 of (296) is a VL comprising the amino acid sequence of SEQ ID NO: 788, more preferably, a VL comprising the amino acid sequence of SEQ ID NO: 2488 (sequence of the IR-058 antibody VL)

IR-059 antibody:

An example of the VH in the above-mentioned H chain having the amino acid sequence of SEQ ID NO: 806 (sequence of the IR-059 antibody H-chain CDR1) as CDR1, the amino acid sequence of SEQ ID NO: 808 (sequence of the IR-059 antibody H-chain CDR2) as CDR2, and the amino acid sequence of SEQ ID NO: 810 (sequence of the IR-059 antibody H-chain CDR3) as CDR3 of (301) is a VH comprising the amino acid sequence of SEQ ID NO: 2490 (sequence of the IR-059 antibody VH)

An example of the VL in the above-mentioned L chain having the amino acid sequence of SEQ ID NO: 812 (sequence of the IR-059 antibody L-chain CDR1) as CDR1, the amino acid sequence of SEQ ID NO: 814 (sequence of the IR-059 antibody L-chain CDR2) as CDR2, and the amino acid sequence of SEQ ID NO: 816 (sequence of the IR-059 antibody L-chain CDR3) as CDR3 of (302) is a VL comprising the amino acid sequence of SEQ ID NO: 804, more preferably, a VL comprising the amino acid sequence of SEQ ID NO: 2492 (sequence of the IR-059 antibody VL)

IR-060 antibody:

An example of the VH in the above-mentioned H chain having the amino acid sequence of SEQ ID NO: 822 (sequence of the IR-060 antibody H-chain CDR1) as CDR1, the amino acid sequence of SEQ ID NO: 824 (sequence of the IR-060 antibody H-chain CDR2) as CDR2, and the amino acid sequence of SEQ ID NO: 826 (sequence of the IR-060 antibody H-chain CDR3) as CDR3 of (307) is a VH comprising the amino acid sequence of SEQ ID NO: 2494 (sequence of the IR-060 antibody VH)

An example of the VL in the above-mentioned L chain having the amino acid sequence of SEQ ID NO: 828 (sequence of the IR-060 antibody L-chain CDR1) as CDR1, the amino acid sequence of SEQ ID NO: 830 (sequence of the IR-060 antibody L-chain CDR2) as CDR2, and the amino acid sequence of SEQ ID NO: 832 (sequence of the IR-060 antibody L-chain CDR3) as CDR3 of (308) is a VL comprising the amino acid sequence of SEQ ID NO: 820, more preferably, a VL comprising the amino acid sequence of SEQ ID NO: 2496 (sequence of the IR-060 antibody VL)

IR-061 antibody:

An example of the VH in the above-mentioned H chain having the amino acid sequence of SEQ ID NO: 838 (sequence of the IR-061 antibody H-chain CDR1) as CDR1, the amino acid sequence of SEQ ID NO: 840 (sequence of the IR-061 antibody H-chain CDR2) as CDR2, and the amino acid sequence of SEQ ID NO: 842 (sequence of the IR-061 antibody H-chain CDR3) as CDR3 of (313) is a VH comprising the amino acid sequence of SEQ ID NO: 2498 (sequence of the IR-061 antibody VH)

An example of the VL in the above-mentioned L chain having the amino acid sequence of SEQ ID NO: 844 (sequence of the IR-061 antibody L-chain CDR1) as CDR1, the amino acid sequence of SEQ ID NO: 846 (sequence of the IR-061 antibody L-chain CDR2) as CDR2, and the amino acid sequence of SEQ ID NO: 848 (sequence of the IR-061 antibody L-chain CDR3) as CDR3 of (314) is a VL comprising the amino acid sequence of SEQ ID NO: 836, more preferably, a VL comprising the amino acid sequence of SEQ ID NO: 2500 (sequence of the IR-061 antibody VL)

IR-062 antibody:

An example of the VH in the above-mentioned H chain having the amino acid sequence of SEQ ID NO: 854 (sequence of the IR-062 antibody H-chain CDR1) as CDR1, the amino acid sequence of SEQ ID NO: 856 (sequence of the IR-062 antibody H-chain CDR2) as CDR2, and the amino acid sequence of SEQ ID NO: 858 (sequence of the IR-062 antibody H-chain CDR3) as CDR3 of (319) is a VH comprising the amino acid sequence of SEQ ID NO: 2502 (sequence of the IR-062 antibody VH)

An example of the VL in the above-mentioned L chain having the amino acid sequence of SEQ ID NO: 860 (sequence of the IR-062 antibody L-chain CDR1) as CDR1, the amino acid sequence of SEQ ID NO: 862 (sequence of the IR-062 antibody L-chain CDR2) as CDR2, and the amino acid sequence of SEQ ID NO: 864 (sequence of the IR-062 antibody L-chain CDR3) as CDR3 of (320) is a VL comprising the amino acid sequence of SEQ ID NO: 852, more preferably, a VL comprising the amino acid sequence of SEQ ID NO: 2504 (sequence of the IR-062 antibody VL)

IR-063 antibody:

An example of the VH in the above-mentioned H chain having the amino acid sequence of SEQ ID NO: 870 (sequence of the IR-063 antibody H-chain CDR1) as CDR1, the amino acid sequence of SEQ ID NO: 872 (sequence of the IR-063 antibody H-chain CDR2) as CDR2, and the amino acid sequence of SEQ ID NO: 874 (sequence of the IR-063 antibody H-chain CDR3) as CDR3 of (325) is a VH comprising the amino acid sequence of SEQ ID NO: 2506 (sequence of the IR-063 antibody VH)

An example of the VL in the above-mentioned L chain having the amino acid sequence of SEQ ID NO: 876 (sequence of the IR-063 antibody L-chain CDR1) as CDR1, the amino acid sequence of SEQ ID NO: 878 (sequence of the IR-063 antibody L-chain CDR2) as CDR2, and the amino acid sequence of SEQ ID NO: 880 (sequence of the IR-063 antibody L-chain CDR3) as CDR3 of (326) is a VL comprising the amino acid sequence of SEQ ID NO: 868, more preferably, a VL comprising the amino acid sequence of SEQ ID NO: 2508 (sequence of the IR-063 antibody VL)

IR-064 antibody:

An example of the VH in the above-mentioned H chain having the amino acid sequence of SEQ ID NO: 886 (sequence of the IR-064 antibody H-chain CDR1) as CDR1, the amino acid sequence of SEQ ID NO: 888 (sequence of the IR-064 antibody H-chain CDR2) as CDR2, and the amino acid sequence of SEQ ID NO: 890 (sequence of the IR-064 antibody H-chain CDR3) as CDR3 of (331) is a VH comprising the amino acid sequence of SEQ ID NO: 2510 (sequence of the IR-064 antibody VH)

An example of the VL in the above-mentioned L chain having the amino acid sequence of SEQ ID NO: 892 (sequence of the IR-064 antibody L-chain CDR1) as CDR1, the amino acid sequence of SEQ ID NO: 894 (sequence of the IR-064 antibody L-chain CDR2) as CDR2, and the amino acid sequence of SEQ ID NO: 896 (sequence of the IR-064 antibody L-chain CDR3) as CDR3 of (332) is a VL comprising the amino acid sequence of SEQ ID NO: 884, more preferably, a VL comprising the amino acid sequence of SEQ ID NO: 2512 (sequence of the IR-064 antibody VL)

IR-065 antibody:

An example of the VH in the above-mentioned H chain having the amino acid sequence of SEQ ID NO: 902 (sequence of the IR-065 antibody H-chain CDR1) as CDR1, the amino acid sequence of SEQ ID NO: 904 (sequence of the IR-065 antibody H-chain CDR2) as CDR2, and the amino acid sequence of SEQ ID NO: 906 (sequence of the IR-065 antibody H-chain CDR3) as CDR3 of (337) is a VH comprising the amino acid sequence of SEQ ID NO: 2514 (sequence of the IR-065 antibody VH)

An example of the VL in the above-mentioned L chain having the amino acid sequence of SEQ ID NO: 908 (sequence of the IR-065 antibody L-chain CDR1) as CDR1, the amino acid sequence of SEQ ID NO: 910 (sequence of the IR-065 antibody L-chain CDR2) as CDR2, and the amino acid sequence of SEQ ID NO: 912 (sequence of the IR-065 antibody L-chain CDR3) as CDR3 of (338) is a VL comprising the amino acid sequence of SEQ ID NO: 900, more preferably, a VL comprising the amino acid sequence of SEQ ID NO: 2516 (sequence of the IR-065 antibody VL)

IR-066 antibody:

An example of the VH in the above-mentioned H chain having the amino acid sequence of SEQ ID NO: 918 (sequence of the IR-066 antibody H-chain CDR1) as CDR1, the amino acid sequence of SEQ ID NO: 920 (sequence of the IR-066 antibody H-chain CDR2) as CDR2, and the amino acid sequence of SEQ ID NO: 922 (sequence of the IR-066 antibody H-chain CDR3) as CDR3 of (343) is a VH comprising the amino acid sequence of SEQ ID NO: 2518 (sequence of the IR-066 antibody VH)

An example of the VL in the above-mentioned L chain having the amino acid sequence of SEQ ID NO: 924 (sequence of the IR-066 antibody L-chain CDR1) as CDR1, the amino acid sequence of SEQ ID NO: 926 (sequence of the IR-066 antibody L-chain CDR2) as CDR2, and the amino acid sequence of SEQ ID NO: 928 (sequence of the IR-066 antibody L-chain CDR3) as CDR3 of (344) is a VL comprising the amino acid sequence of SEQ ID NO: 916, more preferably, a VL comprising the amino acid sequence of SEQ ID NO: 2520 (sequence of the IR-066 antibody VL)

IR-067 antibody:

An example of the VH in the above-mentioned H chain having the amino acid sequence of SEQ ID NO: 934 (sequence of the IR-067 antibody H-chain CDR1) as CDR1, the amino acid sequence of SEQ ID NO: 936 (sequence of the IR-067 antibody H-chain CDR2) as CDR2, and the amino acid sequence of SEQ ID NO: 938 (sequence of the IR-067 antibody H-chain CDR3) as CDR3 of (349) is a VH comprising the amino acid sequence of SEQ ID NO: 2522 (sequence of the IR-067 antibody VH)

An example of the VL in the above-mentioned L chain having the amino acid sequence of SEQ ID NO: 940 (sequence of the IR-067 antibody L-chain CDR1) as CDR1, the amino acid sequence of SEQ ID NO: 942 (sequence of the IR-067 antibody L-chain CDR2) as CDR2, and the amino acid sequence of SEQ ID NO: 944 (sequence of the IR-067 antibody L-chain CDR3) as CDR3 of (350) is a VL comprising the amino acid sequence of SEQ ID NO: 932, more preferably, a VL comprising the amino acid sequence of SEQ ID NO: 2524 (sequence of the IR-067 antibody VL)

IR-068 antibody:

An example of the VH in the above-mentioned H chain having the amino acid sequence of SEQ ID NO: 950 (sequence of the IR-068 antibody H-chain CDR1) as CDR1, the amino acid sequence of SEQ ID NO: 952 (sequence of the IR-068 antibody H-chain CDR2) as CDR2, and the amino acid sequence of SEQ ID NO: 954 (sequence of the IR-068 antibody H-chain CDR3) as CDR3 of (355) is a VH comprising the amino acid sequence of SEQ ID NO: 2526 (sequence of the IR-068 antibody VH)

An example of the VL in the above-mentioned L chain having the amino acid sequence of SEQ ID NO: 956 (sequence of the IR-068 antibody L-chain CDR1) as CDR1, the amino acid sequence of SEQ ID NO: 958 (sequence of the IR-068 antibody L-chain CDR2) as CDR2, and the amino acid sequence of SEQ ID NO: 960 (sequence of the IR-068 antibody L-chain CDR3) as CDR3 of (356) is a VL comprising the amino acid sequence of SEQ ID NO: 948, more preferably, a VL comprising the amino acid sequence of SEQ ID NO: 2528 (sequence of the IR-068 antibody VL)

IR-069 antibody:

An example of the VH in the above-mentioned H chain having the amino acid sequence of SEQ ID NO: 966 (sequence of the IR-069 antibody H-chain CDR1) as CDR1, the amino acid sequence of SEQ ID NO: 968 (sequence of the IR-069 antibody H-chain CDR2) as CDR2, and the amino acid sequence of SEQ ID NO: 970 (sequence of the IR-069 antibody H-chain CDR3) as CDR3 of (361) is a VH comprising the amino acid sequence of SEQ ID NO: 2530 (sequence of the IR-069 antibody VH)

An example of the VL in the above-mentioned L chain having the amino acid sequence of SEQ ID NO: 972 (sequence of the IR-069 antibody L-chain CDR1) as CDR1, the amino acid sequence of SEQ ID NO: 974 (sequence of the IR-069 antibody L-chain CDR2) as CDR2, and the amino acid sequence of SEQ ID NO: 976 (sequence of the IR-069 antibody L-chain CDR3) as CDR3 of (362) is a VL comprising the amino acid sequence of SEQ ID NO: 964, more preferably, a VL comprising the amino acid sequence of SEQ ID NO: 2532 (sequence of the IR-069 antibody VL)

IR-070 antibody:

An example of the VH in the above-mentioned H chain having the amino acid sequence of SEQ ID NO: 982 (sequence of the IR-070 antibody H-chain CDR1) as CDR1, the amino acid sequence of SEQ ID NO: 984 (sequence of the IR-070 antibody H-chain CDR2) as CDR2, and the amino acid sequence of SEQ ID NO: 986 (sequence of the IR-070 antibody H-chain CDR3) as CDR3 of (367) is a VH comprising the amino acid sequence of SEQ ID NO: 2534 (sequence of the IR-070 antibody VH)

An example of the VL in the above-mentioned L chain having the amino acid sequence of SEQ ID NO: 988 (sequence of the IR-070 antibody L-chain CDR1) as CDR1, the amino acid sequence of SEQ ID NO: 990 (sequence of the IR-070 antibody L-chain CDR2) as CDR2, and the amino acid sequence of SEQ ID NO: 992 (sequence of the IR-070 antibody L-chain CDR3) as CDR3 of (368) is a VL comprising the amino acid sequence of SEQ ID NO: 980, more preferably, a VL comprising the amino acid sequence of SEQ ID NO: 2536 (sequence of the IR-070 antibody VL)

IR-071 antibody:

An example of the VH in the above-mentioned H chain having the amino acid sequence of SEQ ID NO: 998 (sequence of the IR-071 antibody H-chain CDR1) as CDR1, the amino acid sequence of SEQ ID NO: 1000 (sequence of the IR-071 antibody H-chain CDR2) as CDR2, and the amino acid sequence of SEQ ID NO: 1002 (sequence of the IR-071 antibody H-chain CDR3) as CDR3 of (373) is a VH comprising the amino acid sequence of SEQ ID NO: 2538 (sequence of the IR-071 antibody VH)

An example of the VL in the above-mentioned L chain having the amino acid sequence of SEQ ID NO: 1004 (sequence of the IR-071 antibody L-chain CDR1) as CDR1, the amino acid sequence of SEQ ID NO: 1006 (sequence of the IR-071 antibody L-chain CDR2) as CDR2, and the amino acid sequence of SEQ ID NO: 1008 (sequence of the IR-071 antibody L-chain CDR3) as CDR3 of (374) is a VL comprising the amino acid sequence of SEQ ID NO: 996, more preferably, a VL comprising the amino acid sequence of SEQ ID NO: 2540 (sequence of the IR-071 antibody VL)

IR-072 antibody:

An example of the VH in the above-mentioned H chain having the amino acid sequence of SEQ ID NO: 1014 (sequence of the IR-072 antibody H-chain CDR1) as CDR1, the amino acid sequence of SEQ ID NO: 1016 (sequence of the IR-072 antibody H-chain CDR2) as CDR2, and the amino acid sequence of SEQ ID NO: 1018 (sequence of the IR-072 antibody H-chain CDR3) as CDR3 of (379) is a VH comprising the amino acid sequence of SEQ ID NO: 2542 (sequence of the IR-072 antibody VH)

An example of the VL in the above-mentioned L chain having the amino acid sequence of SEQ ID NO: 1020 (sequence of the IR-072 antibody L-chain CDR1) as CDR1, the amino acid sequence of SEQ ID NO: 1022 (sequence of the IR-072 antibody L-chain CDR2) as CDR2, and the amino acid sequence of SEQ ID NO: 1024 (sequence of the IR-072 antibody L-chain CDR3) as CDR3 of (380) is a VL comprising the amino acid sequence of SEQ ID NO: 1012, more preferably, a VL comprising the amino acid sequence of SEQ ID NO: 2544 (sequence of the IR-072 antibody VL)

IR-073 antibody:

An example of the VH in the above-mentioned H chain having the amino acid sequence of SEQ ID NO: 1030 (sequence of the IR-073 antibody H-chain CDR1) as CDR1, the amino acid sequence of SEQ ID NO: 1032 (sequence of the IR-073 antibody H-chain CDR2) as CDR2, and the amino acid sequence of SEQ ID NO: 1034 (sequence of the IR-073 antibody H-chain CDR3) as CDR3 of (385) is a VH comprising the amino acid sequence of SEQ ID NO: 2546 (sequence of the IR-073 antibody VH)

An example of the VL in the above-mentioned L chain having the amino acid sequence of SEQ ID NO: 1036 (sequence of the IR-073 antibody L-chain CDR1) as CDR1, the amino acid sequence of SEQ ID NO: 1038 (sequence of the IR-073 antibody L-chain CDR2) as CDR2, and the amino acid sequence of SEQ ID NO: 1040 (sequence of the IR-073 antibody L-chain CDR3) as CDR3 of (386) is a VL comprising the amino acid sequence of SEQ ID NO: 1028, more preferably, a VL comprising the amino acid sequence of SEQ ID NO: 2548 (sequence of the IR-073 antibody VL)

IR-074 antibody:

An example of the VH in the above-mentioned H chain having the amino acid sequence of SEQ ID NO: 1046 (sequence of the IR-074 antibody H-chain CDR1) as CDR1, the amino acid sequence of SEQ ID NO: 1048 (sequence of the IR-074 antibody H-chain CDR2) as CDR2, and the amino acid sequence of SEQ ID NO: 1050 (sequence of the IR-074 antibody H-chain CDR3) as CDR3 of (391) is a VH comprising the amino acid sequence of SEQ ID NO: 2550 (sequence of the IR-074 antibody VH)

An example of the VL in the above-mentioned L chain having the amino acid sequence of SEQ ID NO: 1052 (sequence of the IR-074 antibody L-chain CDR1) as CDR1, the amino acid sequence of SEQ ID NO: 1054 (sequence of the IR-074 antibody L-chain CDR2) as CDR2, and the amino acid sequence of SEQ ID NO: 1056 (sequence of the IR-074 antibody L-chain CDR3) as CDR3 of (392) is a VL comprising the amino acid sequence of SEQ ID NO: 1044, more preferably, a VL comprising the amino acid sequence of SEQ ID NO: 2552 (sequence of the IR-074 antibody VL)

IR-075 antibody:

An example of the VH in the above-mentioned H chain having the amino acid sequence of SEQ ID NO: 1062 (sequence of the IR-075 antibody H-chain CDR1) as CDR1, the amino acid sequence of SEQ ID NO: 1064 (sequence of the IR-075 antibody H-chain CDR2) as CDR2, and the amino acid sequence of SEQ ID NO: 1066 (sequence of the IR-075 antibody H-chain CDR3) as CDR3 of (397) is a VH comprising the amino acid sequence of SEQ ID NO: 2554 (sequence of the IR-075 antibody VH)

An example of the VL in the above-mentioned L chain having the amino acid sequence of SEQ ID NO: 1068 (sequence of the IR-075 antibody L-chain CDR1) as CDR1, the amino acid sequence of SEQ ID NO: 1070 (sequence of the IR-075 antibody L-chain CDR2) as CDR2, and the amino acid sequence of SEQ ID NO: 1072 (sequence of the IR-075 antibody L-chain CDR3) as CDR3 of (398) is a VL comprising the amino acid sequence of SEQ ID NO: 1060, more preferably, a VL comprising the amino acid sequence of SEQ ID NO: 2556 (sequence of the IR-075 antibody VL)

IR-076 antibody:

An example of the VH in the above-mentioned H chain having the amino acid sequence of SEQ ID NO: 1078 (sequence of the IR-076 antibody H-chain CDR1) as CDR1, the amino acid sequence of SEQ ID NO: 1080 (sequence of the IR-076 antibody H-chain CDR2) as CDR2, and the amino acid sequence of SEQ ID NO: 1082 (sequence of the IR-076 antibody H-chain CDR3) as CDR3 of (403) is a VH comprising the amino acid sequence of SEQ ID NO: 2558 (sequence of the IR-076 antibody VH)

An example of the VL in the above-mentioned L chain having the amino acid sequence of SEQ ID NO: 1084 (sequence of the IR-076 antibody L-chain CDR1) as CDR1, the amino acid sequence of SEQ ID NO: 1086 (sequence of the IR-076 antibody L-chain CDR2) as CDR2, and the amino acid sequence of SEQ ID NO: 1088 (sequence of the IR-076 antibody L-chain CDR3) as CDR3 of (404) is a VL comprising the amino acid sequence of SEQ ID NO: 1076, more preferably, a VL comprising the amino acid sequence of SEQ ID NO: 2560 (sequence of the IR-076 antibody VL)

IR-077 antibody:

An example of the VH in the above-mentioned H chain having the amino acid sequence of SEQ ID NO: 1094 (sequence of the IR-077 antibody H-chain CDR1) as CDR1, the amino acid sequence of SEQ ID NO: 1096 (sequence of the IR-077 antibody H-chain CDR2) as CDR2, and the amino acid sequence of SEQ ID NO: 1098 (sequence of the IR-077 antibody H-chain CDR3) as CDR3 of (409) is a VH comprising the amino acid sequence of SEQ ID NO: 2562 (sequence of the IR-077 antibody VH)

An example of the VL in the above-mentioned L chain having the amino acid sequence of SEQ ID NO: 1100 (sequence of the IR-077 antibody L-chain CDR1) as CDR1, the amino acid sequence of SEQ ID NO: 1102 (sequence of the IR-077 antibody L-chain CDR2) as CDR2, and the amino acid sequence of SEQ ID NO: 1104 (sequence of the IR-077 antibody L-chain CDR3) as CDR3 of (410) is a VL comprising the amino acid sequence of SEQ ID NO: 1092, more preferably, a VL comprising the amino acid sequence of SEQ ID NO: 2564 (sequence of the IR-077 antibody VL)

IR-078 antibody:
An example of the VH in the above-mentioned H chain having the amino acid sequence of SEQ ID NO: 1110 (sequence of the IR-078 antibody H-chain CDR1) as CDR1, the amino acid sequence of SEQ ID NO: 1112 (sequence of the IR-078 antibody H-chain CDR2) as CDR2, and the amino acid sequence of SEQ ID NO: 1114 (sequence of the IR-078 antibody H-chain CDR3) as CDR3 of (415) is a VH comprising the amino acid sequence of SEQ ID NO: 1106, more preferably, a VH comprising the amino acid sequence of SEQ ID NO: 2566 (sequence of the IR-078 antibody VH)

An example of the VL in the above-mentioned L chain having the amino acid sequence of SEQ ID NO: 1116 (sequence of the IR-078 antibody L-chain CDR1) as CDR1, the amino acid sequence of SEQ ID NO: 1118 (sequence of the IR-078 antibody L-chain CDR2) as CDR2, and the amino acid sequence of SEQ ID NO: 1120 (sequence of the IR-078 antibody L-chain CDR3) as CDR3 of (416) is a VL comprising the amino acid sequence of SEQ ID NO: 1108, more preferably, a VL comprising the amino acid sequence of SEQ ID NO: 2568 (sequence of the IR-078 antibody VL)

IR-079 antibody:
An example of the VH in the above-mentioned H chain having the amino acid sequence of SEQ ID NO: 1126 (sequence of the IR-079 antibody H-chain CDR1) as CDR1, the amino acid sequence of SEQ ID NO: 1128 (sequence of the IR-079 antibody H-chain CDR2) as CDR2, and the amino acid sequence of SEQ ID NO: 1130 (sequence of the IR-079 antibody H-chain CDR3) as CDR3 of (421) is a VH comprising the amino acid sequence of SEQ ID NO: 2570 (sequence of the IR-079 antibody VH)

An example of the VL in the above-mentioned L chain having the amino acid sequence of SEQ ID NO: 1132 (sequence of the IR-079 antibody L-chain CDR1) as CDR1, the amino acid sequence of SEQ ID NO: 1134 (sequence of the IR-079 antibody L-chain CDR2) as CDR2, and the amino acid sequence of SEQ ID NO: 1136 (sequence of the IR-079 antibody L-chain CDR3) as CDR3 of (422) is a VL comprising the amino acid sequence of SEQ ID NO: 1124, more preferably, a VL comprising the amino acid sequence of SEQ ID NO: 2572 (sequence of the IR-079 antibody VL)

IR-080 antibody:
An example of the VH in the above-mentioned H chain having the amino acid sequence of SEQ ID NO: 1142 (sequence of the IR-080 antibody H-chain CDR1) as CDR1, the amino acid sequence of SEQ ID NO: 1144 (sequence of the IR-080 antibody H-chain CDR2) as CDR2, and the amino acid sequence of SEQ ID NO: 1146 (sequence of the IR-080 antibody H-chain CDR3) as CDR3 of (427) is a VH comprising the amino acid sequence of SEQ ID NO: 2574 (sequence of the IR-080 antibody VH)

An example of the VL in the above-mentioned L chain having the amino acid sequence of SEQ ID NO: 1148 (sequence of the IR-080 antibody L-chain CDR1) as CDR1, the amino acid sequence of SEQ ID NO: 1150 (sequence of the IR-080 antibody L-chain CDR2) as CDR2, and the amino acid sequence of SEQ ID NO: 1152 (sequence of the IR-080 antibody L-chain CDR3) as CDR3 of (428) is a VL comprising the amino acid sequence of SEQ ID NO: 1140, more preferably, a VL comprising the amino acid sequence of SEQ ID NO: 2576 (sequence of the IR-080 antibody VL)

IR-081 antibody:
An example of the VH in the above-mentioned H chain having the amino acid sequence of SEQ ID NO: 1158 (sequence of the IR-081 antibody H-chain CDR1) as CDR1, the amino acid sequence of SEQ ID NO: 1160 (sequence of the IR-081 antibody H-chain CDR2) as CDR2, and the amino acid sequence of SEQ ID NO: 1162 (sequence of the IR-081 antibody H-chain CDR3) as CDR3 of (433) is a VH comprising the amino acid sequence of SEQ ID NO: 2578 (sequence of the IR-081 antibody VH)

An example of the VL in the above-mentioned L chain having the amino acid sequence of SEQ ID NO: 1164 (sequence of the IR-081 antibody L-chain CDR1) as CDR1, the amino acid sequence of SEQ ID NO: 1166 (sequence of the IR-081 antibody L-chain CDR2) as CDR2, and the amino acid sequence of SEQ ID NO: 1168 (sequence of the IR-081 antibody L-chain CDR3) as CDR3 of (434) is a VL comprising the amino acid sequence of SEQ ID NO: 1156, more preferably, a VL comprising the amino acid sequence of SEQ ID NO: 2580 (sequence of the IR-081 antibody VL)

IR-082 antibody:
An example of the VH in the above-mentioned H chain having the amino acid sequence of SEQ ID NO: 1174 (sequence of the IR-082 antibody H-chain CDR1) as CDR1, the amino acid sequence of SEQ ID NO: 1176 (sequence of the IR-082 antibody H-chain CDR2) as CDR2, and the amino acid sequence of SEQ ID NO: 1178 (sequence of the IR-082 antibody H-chain CDR3) as CDR3 of (439) is a VH comprising the amino acid sequence of SEQ ID NO: 2582 (sequence of the IR-082 antibody VH)

An example of the VL in the above-mentioned L chain having the amino acid sequence of SEQ ID NO: 1180 (sequence of the IR-082 antibody L-chain CDR1) as CDR1, the amino acid sequence of SEQ ID NO: 1182 (sequence of the IR-082 antibody L-chain CDR2) as CDR2, and the amino acid sequence of SEQ ID NO: 1184 (sequence of the IR-082 antibody L-chain CDR3) as CDR3 of (440) is a VL comprising the amino acid sequence of SEQ ID NO: 1172, more preferably, a VL comprising the amino acid sequence of SEQ ID NO: 2584 (sequence of the IR-082 antibody VL)

IR-083 antibody:
An example of the VH in the above-mentioned H chain having the amino acid sequence of SEQ ID NO: 1190 (sequence of the IR-083 antibody H-chain CDR1) as CDR1, the amino acid sequence of SEQ ID NO: 1192 (sequence of the IR-083 antibody H-chain CDR2) as CDR2, and the amino acid sequence of SEQ ID NO: 1194 (sequence of the IR-083 antibody H-chain CDR3) as CDR3 of (445) is a VH comprising the amino acid sequence of SEQ ID NO: 2586 (sequence of the IR-083 antibody VH)

An example of the VL in the above-mentioned L chain having the amino acid sequence of SEQ ID NO: 1196 (sequence of the IR-083 antibody L-chain CDR1) as CDR1, the amino acid sequence of SEQ ID NO: 1198 (sequence of the IR-083 antibody L-chain CDR2) as CDR2, and the amino acid sequence of SEQ ID NO: 1200 (sequence of the IR-083 antibody L-chain CDR3) as CDR3 of (446) is a VL comprising the amino acid sequence of SEQ ID NO: 1188, more preferably, a VL comprising the amino acid sequence of SEQ ID NO: 2588 (sequence of the IR-083 antibody VL)

IR-084 antibody:
An example of the VH in the above-mentioned H chain having the amino acid sequence of SEQ ID NO: 1206 (sequence of the IR-084 antibody H-chain CDR1) as CDR1, the amino acid sequence of SEQ ID NO: 1208 (sequence of the IR-084 antibody H-chain CDR2) as CDR2, and the amino acid sequence of SEQ ID NO: 1210 (sequence of the IR-084 antibody H-chain CDR3) as CDR3 of (451) is a VH comprising the amino acid sequence of SEQ ID NO: 2590 (sequence of the IR-084 antibody VH)

An example of the VL in the above-mentioned L chain having the amino acid sequence of SEQ ID NO: 1212 (sequence of the IR-084 antibody L-chain CDR1) as CDR1, the amino acid sequence of SEQ ID NO: 1214 (sequence of the IR-084 antibody L-chain CDR2) as CDR2, and the amino acid sequence of SEQ ID NO: 1216 (sequence of the IR-084 antibody L-chain CDR3) as CDR3 of (452) is a VL comprising the amino acid sequence of SEQ ID NO: 1204, more preferably, a VL comprising the amino acid sequence of SEQ ID NO: 2592 (sequence of the IR-084 antibody VL)

IR-085 antibody:

An example of the VH in the above-mentioned H chain having the amino acid sequence of SEQ ID NO: 1222 (sequence of the IR-085 antibody H-chain CDR1) as CDR1, the amino acid sequence of SEQ ID NO: 1224 (sequence of the IR-085 antibody H-chain CDR2) as CDR2, and the amino acid sequence of SEQ ID NO: 1226 (sequence of the IR-085 antibody H-chain CDR3) as CDR3 of (457) is a VH comprising the amino acid sequence of SEQ ID NO: 2594 (sequence of the IR-085 antibody VH)

An example of the VL in the above-mentioned L chain having the amino acid sequence of SEQ ID NO: 1228 (sequence of the IR-085 antibody L-chain CDR1) as CDR1, the amino acid sequence of SEQ ID NO: 1230 (sequence of the IR-085 antibody L-chain CDR2) as CDR2, and the amino acid sequence of SEQ ID NO: 1232 (sequence of the IR-085 antibody L-chain CDR3) as CDR3 of (458) is a VL comprising the amino acid sequence of SEQ ID NO: 1220, more preferably, a VL comprising the amino acid sequence of SEQ ID NO: 2596 (sequence of the IR-085 antibody VL)

IR-086 antibody:

An example of the VH in the above-mentioned H chain having the amino acid sequence of SEQ ID NO: 1238 (sequence of the IR-086 antibody H-chain CDR1) as CDR1, the amino acid sequence of SEQ ID NO: 1240 (sequence of the IR-086 antibody H-chain CDR2) as CDR2, and the amino acid sequence of SEQ ID NO: 1242 (sequence of the IR-086 antibody H-chain CDR3) as CDR3 of (463) is a VH comprising the amino acid sequence of SEQ ID NO: 2598 (sequence of the IR-086 antibody VH)

An example of the VL in the above-mentioned L chain having the amino acid sequence of SEQ ID NO: 1244 (sequence of the IR-086 antibody L-chain CDR1) as CDR1, the amino acid sequence of SEQ ID NO: 1246 (sequence of the IR-086 antibody L-chain CDR2) as CDR2, and the amino acid sequence of SEQ ID NO: 1248 (sequence of the IR-086 antibody L-chain CDR3) as CDR3 of (464) is a VL comprising the amino acid sequence of SEQ ID NO: 1236, more preferably, a VL comprising the amino acid sequence of SEQ ID NO: 2600 (sequence of the IR-086 antibody VL)

IR-087 antibody:

An example of the VH in the above-mentioned H chain having the amino acid sequence of SEQ ID NO: 1254 (sequence of the IR-087 antibody H-chain CDR1) as CDR1, the amino acid sequence of SEQ ID NO: 1256 (sequence of the IR-087 antibody H-chain CDR2) as CDR2, and the amino acid sequence of SEQ ID NO: 1258 (sequence of the IR-087 antibody H-chain CDR3) as CDR3 of (469) is a VH comprising the amino acid sequence of SEQ ID NO: 2602 (sequence of the IR-087 antibody VH)

An example of the VL in the above-mentioned L chain having the amino acid sequence of SEQ ID NO: 1260 (sequence of the IR-087 antibody L-chain CDR1) as CDR1, the amino acid sequence of SEQ ID NO: 1262 (sequence of the IR-087 antibody L-chain CDR2) as CDR2, and the amino acid sequence of SEQ ID NO: 1264 (sequence of the IR-087 antibody L-chain CDR3) as CDR3 of (470) is a VL comprising the amino acid sequence of SEQ ID NO: 1252, more preferably, a VL comprising the amino acid sequence of SEQ ID NO: 2604 (sequence of the IR-087 antibody VL)

IR-088 antibody:

An example of the VH in the above-mentioned H chain having the amino acid sequence of SEQ ID NO: 1270 (sequence of the IR-088 antibody H-chain CDR1) as CDR1, the amino acid sequence of SEQ ID NO: 1272 (sequence of the IR-088 antibody H-chain CDR2) as CDR2, and the amino acid sequence of SEQ ID NO: 1274 (sequence of the IR-088 antibody H-chain CDR3) as CDR3 of (475) is a VH comprising the amino acid sequence of SEQ ID NO: 2606 (sequence of the IR-088 antibody VH)

An example of the VL in the above-mentioned L chain having the amino acid sequence of SEQ ID NO: 1276 (sequence of the IR-088 antibody L-chain CDR1) as CDR1, the amino acid sequence of SEQ ID NO: 1278 (sequence of the IR-088 antibody L-chain CDR2) as CDR2, and the amino acid sequence of SEQ ID NO: 1280 (sequence of the IR-088 antibody L-chain CDR3) as CDR3 of (476) is a VL comprising the amino acid sequence of SEQ ID NO: 1268, more preferably, a VL comprising the amino acid sequence of SEQ ID NO: 2608 (sequence of the IR-088 antibody VL)

IR-089 antibody:

An example of the VH in the above-mentioned H chain having the amino acid sequence of SEQ ID NO: 1286 (sequence of the IR-089 antibody H-chain CDR1) as CDR1, the amino acid sequence of SEQ ID NO: 1288 (sequence of the IR-089 antibody H-chain CDR2) as CDR2, and the amino acid sequence of SEQ ID NO: 1290 (sequence of the IR-089 antibody H-chain CDR3) as CDR3 of (481) is a VH comprising the amino acid sequence of SEQ ID NO: 2610 (sequence of the IR-089 antibody VH)

An example of the VL in the above-mentioned L chain having the amino acid sequence of SEQ ID NO: 1292 (sequence of the IR-089 antibody L-chain CDR1) as CDR1, the amino acid sequence of SEQ ID NO: 1294 (sequence of the IR-089 antibody L-chain CDR2) as CDR2, and the amino acid sequence of SEQ ID NO: 1296 (sequence of the IR-089 antibody L-chain CDR3) as CDR3 of (482) is a VL comprising the amino acid sequence of SEQ ID NO: 1284, more preferably, a VL comprising the amino acid sequence of SEQ ID NO: 2612 (sequence of the IR-089 antibody VL)

IR-090 antibody:

An example of the VH in the above-mentioned H chain having the amino acid sequence of SEQ ID NO: 1302 (sequence of the IR-090 antibody H-chain CDR1) as CDR1, the amino acid sequence of SEQ ID NO: 1304 (sequence of the IR-090 antibody H-chain CDR2) as CDR2, and the amino acid sequence of SEQ ID NO: 1306 (sequence of the IR-090 antibody H-chain CDR3) as CDR3 of (487) is a VH comprising the amino acid sequence of SEQ ID NO: 2614 (sequence of the IR-090 antibody VH)

An example of the VL in the above-mentioned L chain having the amino acid sequence of SEQ ID NO: 1308 (sequence of the IR-090 antibody L-chain CDR1) as CDR1, the amino acid sequence of SEQ ID NO: 1310 (sequence of the IR-090 antibody L-chain CDR2) as CDR2, and the amino acid sequence of SEQ ID NO: 1312 (sequence of the IR-090 antibody L-chain CDR3) as CDR3 of (488) is a VL comprising the amino acid sequence of SEQ ID NO: 1300, more preferably, a VL comprising the amino acid sequence of SEQ ID NO: 2616 (sequence of the IR-090 antibody VL)

IR-092 antibody:

An example of the VH in the above-mentioned H chain having the amino acid sequence of SEQ ID NO: 1318 (sequence of the IR-092 antibody H-chain CDR1) as CDR1, the amino acid sequence of SEQ ID NO: 1320 (sequence of the IR-092 antibody H-chain CDR2) as CDR2, and the amino acid sequence of SEQ ID NO: 1322 (sequence of the IR-092 antibody H-chain CDR3) as CDR3 of (493) is a VH comprising the amino acid sequence of SEQ ID NO: 2618 (sequence of the IR-092 antibody VH)

An example of the VL in the above-mentioned L chain having the amino acid sequence of SEQ ID NO: 1324 (sequence of the IR-092 antibody L-chain CDR1) as CDR1, the amino acid sequence of SEQ ID NO: 1326 (sequence of the IR-092 antibody L-chain CDR2) as CDR2, and the amino acid sequence of SEQ ID NO: 1328 (sequence of the IR-092 antibody L-chain CDR3) as CDR3 of (494) is a VL comprising the amino acid sequence of SEQ ID NO: 1316, more preferably, a VL comprising the amino acid sequence of SEQ ID NO: 2620 (sequence of the IR-092 antibody VL)

IR-093 antibody:

An example of the VH in the above-mentioned H chain having the amino acid sequence of SEQ ID NO: 1334 (sequence of the IR-093 antibody H-chain CDR1) as CDR1, the amino acid sequence of SEQ ID NO: 1336 (sequence of the IR-093 antibody H-chain CDR2) as CDR2, and the amino acid sequence of SEQ ID NO: 1338 (sequence of the IR-093 antibody H-chain CDR3) as CDR3 of (499) is a VH comprising the amino acid sequence of SEQ ID NO: 2622 (sequence of the IR-093 antibody VH)

An example of the VL in the above-mentioned L chain having the amino acid sequence of SEQ ID NO: 1340 (sequence of the IR-093 antibody L-chain CDR1) as CDR1, the amino acid sequence of SEQ ID NO: 1342 (sequence of the IR-093 antibody L-chain CDR2) as CDR2, and the amino acid sequence of SEQ ID NO: 1344 (sequence of the IR-093 antibody L-chain CDR3) as CDR3 of (500) is a VL comprising the amino acid sequence of SEQ ID NO: 1332, more preferably, a VL comprising the amino acid sequence of SEQ ID NO: 2624 (sequence of the IR-093 antibody VL)

IR-094 antibody:

An example of the VH in the above-mentioned H chain having the amino acid sequence of SEQ ID NO: 1350 (sequence of the IR-094 antibody H-chain CDR1) as CDR1, the amino acid sequence of SEQ ID NO: 1352 (sequence of the IR-094 antibody H-chain CDR2) as CDR2, and the amino acid sequence of SEQ ID NO: 1354 (sequence of the IR-094 antibody H-chain CDR3) as CDR3 of (505) is a VH comprising the amino acid sequence of SEQ ID NO: 1346, more preferably, a VH comprising the amino acid sequence of SEQ ID NO: 2626 (sequence of the IR-094 antibody VH)

An example of the VL in the above-mentioned L chain having the amino acid sequence of SEQ ID NO: 1356 (sequence of the IR-094 antibody L-chain CDR1) as CDR1, the amino acid sequence of SEQ ID NO: 1358 (sequence of the IR-094 antibody L-chain CDR2) as CDR2, and the amino acid sequence of SEQ ID NO: 1360 (sequence of the IR-094 antibody L-chain CDR3) as CDR3 of (506) is a VL comprising the amino acid sequence of SEQ ID NO: 1348, more preferably, a VL comprising the amino acid sequence of SEQ ID NO: 2628 (sequence of the IR-094 antibody VL)

IR-095 antibody:

An example of the VH in the above-mentioned H chain having the amino acid sequence of SEQ ID NO: 1366 (sequence of the IR-095 antibody H-chain CDR1) as CDR1, the amino acid sequence of SEQ ID NO: 1368 (sequence of the IR-095 antibody H-chain CDR2) as CDR2, and the amino acid sequence of SEQ ID NO: 1370 (sequence of the IR-095 antibody H-chain CDR3) as CDR3 of (511) is a VH comprising the amino acid sequence of SEQ ID NO: 2630 (sequence of the IR-095 antibody VH)

An example of the VL in the above-mentioned L chain having the amino acid sequence of SEQ ID NO: 1372 (sequence of the IR-095 antibody L-chain CDR1) as CDR1, the amino acid sequence of SEQ ID NO: 1374 (sequence of the IR-095 antibody L-chain CDR2) as CDR2, and the amino acid sequence of SEQ ID NO: 1376 (sequence of the IR-095 antibody L-chain CDR3) as CDR3 of (512) is a VL comprising the amino acid sequence of SEQ ID NO: 1364, more preferably, a VL comprising the amino acid sequence of SEQ ID NO: 2632 (sequence of the IR-095 antibody VL)

IR-097 antibody:

An example of the VH in the above-mentioned H chain having the amino acid sequence of SEQ ID NO: 1382 (sequence of the IR-097 antibody H-chain CDR1) as CDR1, the amino acid sequence of SEQ ID NO: 1384 (sequence of the IR-097 antibody H-chain CDR2) as CDR2, and the amino acid sequence of SEQ ID NO: 1386 (sequence of the IR-097 antibody H-chain CDR3) as CDR3 of (517) is a VH comprising the amino acid sequence of SEQ ID NO: 2634 (sequence of the IR-097 antibody VH)

An example of the VL in the above-mentioned L chain having the amino acid sequence of SEQ ID NO: 1388 (sequence of the IR-097 antibody L-chain CDR1) as CDR1, the amino acid sequence of SEQ ID NO: 1390 (sequence of the IR-097 antibody L-chain CDR2) as CDR2, and the amino acid sequence of SEQ ID NO: 1392 (sequence of the IR-097 antibody L-chain CDR3) as CDR3 of (518) is a VL comprising the amino acid sequence of SEQ ID NO: 1380, more preferably, a VL comprising the amino acid sequence of SEQ ID NO: 2636 (sequence of the IR-097 antibody VL)

IR-098 antibody:

An example of the VH in the above-mentioned H chain having the amino acid sequence of SEQ ID NO: 1398 (sequence of the IR-098 antibody H-chain CDR1) as CDR1, the amino acid sequence of SEQ ID NO: 1400 (sequence of the IR-098 antibody H-chain CDR2) as CDR2, and the amino acid sequence of SEQ ID NO: 1402 (sequence of the IR-098 antibody H-chain CDR3) as CDR3 of (523) is a VH comprising the amino acid sequence of SEQ ID NO: 2638 (sequence of the IR-098 antibody VH)

An example of the VL in the above-mentioned L chain having the amino acid sequence of SEQ ID NO: 1404 (sequence of the IR-098 antibody L-chain CDR1) as CDR1, the amino acid sequence of SEQ ID NO: 1406 (sequence of the IR-098 antibody L-chain CDR2) as CDR2, and the amino acid sequence of SEQ ID NO: 1408 (sequence of the IR-098 antibody L-chain CDR3) as CDR3 of (524) is a VL comprising the amino acid sequence of SEQ ID NO: 1396, more preferably, a VL comprising the amino acid sequence of SEQ ID NO: 2640 (sequence of the IR-098 antibody VL)

IR-100 antibody:

An example of the VH in the above-mentioned H chain having the amino acid sequence of SEQ ID NO: 1414 (sequence of the IR-100 antibody H-chain CDR1) as CDR1, the amino acid sequence of SEQ ID NO: 1416 (sequence of the IR-100 antibody H-chain CDR2) as CDR2, and the amino acid sequence of SEQ ID NO: 1418 (sequence of the IR-100 antibody H-chain CDR3) as CDR3 of (529) is a VH comprising the amino acid sequence of SEQ ID NO: 2642 (sequence of the IR-100 antibody VH)

An example of the VL in the above-mentioned L chain having the amino acid sequence of SEQ ID NO: 1420 (sequence of the IR-100 antibody L-chain CDR1) as CDR1, the amino acid sequence of SEQ ID NO: 1422 (sequence of the IR-100 antibody L-chain CDR2) as CDR2, and the amino acid sequence of SEQ ID NO: 1424 (sequence of the IR-100 antibody L-chain CDR3) as CDR3 of (530) is a VL comprising the amino acid sequence of SEQ ID NO: 1412, more preferably, a VL comprising the amino acid sequence of SEQ ID NO: 2644 (sequence of the IR-100 antibody VL).

IR-101 antibody:

An example of the VH in the above-mentioned H chain having the amino acid sequence of SEQ ID NO: 1430 (sequence of the IR-101 antibody H-chain CDR1) as CDR1, the amino acid sequence of SEQ ID NO: 1432 (sequence of the IR-101 antibody H-chain CDR2) as CDR2, and the amino acid sequence of SEQ ID NO: 1434 (sequence of the IR-101 antibody H-chain CDR3) as CDR3 of (535) is a VH comprising the amino acid sequence of SEQ ID NO: 2646 (sequence of the IR-101 antibody VH).

An example of the VL in the above-mentioned L chain having the amino acid sequence of SEQ ID NO: 1436 (sequence of the IR-101 antibody L-chain CDR1) as CDR1, the amino acid sequence of SEQ ID NO: 1438 (sequence of the IR-101 antibody L-chain CDR2) as CDR2, and the amino acid sequence of SEQ ID NO: 1440 (sequence of the IR-101 antibody L-chain CDR3) as CDR3 of (536) is a VL comprising the amino acid sequence of SEQ ID NO: 1428, more preferably, a VL comprising the amino acid sequence of SEQ ID NO: 2648 (sequence of the IR-101 antibody VL).

IR-102 antibody:

An example of the VH in the above-mentioned H chain having the amino acid sequence of SEQ ID NO: 1446 (sequence of the IR-102 antibody H-chain CDR1) as CDR1, the amino acid sequence of SEQ ID NO: 1448 (sequence of the IR-102 antibody H-chain CDR2) as CDR2, and the amino acid sequence of SEQ ID NO: 1450 (sequence of the IR-102 antibody H-chain CDR3) as CDR3 of (541) is a VH comprising the amino acid sequence of SEQ ID NO: 2650 (sequence of the IR-102 antibody VH).

An example of the VL in the above-mentioned L chain having the amino acid sequence of SEQ ID NO: 1452 (sequence of the IR-102 antibody L-chain CDR1) as CDR1, the amino acid sequence of SEQ ID NO: 1454 (sequence of the IR-102 antibody L-chain CDR2) as CDR2, and the amino acid sequence of SEQ ID NO: 1456 (sequence of the IR-102 antibody L-chain CDR3) as CDR3 of (542) is a VL comprising the amino acid sequence of SEQ ID NO: 1444, more preferably, a VL comprising the amino acid sequence of SEQ ID NO: 2652 (sequence of the IR-102 antibody VL).

IR-104 antibody:

An example of the VH in the above-mentioned H chain having the amino acid sequence of SEQ ID NO: 1462 (sequence of the IR-104 antibody H-chain CDR1) as CDR1, the amino acid sequence of SEQ ID NO: 1464 (sequence of the IR-104 antibody H-chain CDR2) as CDR2, and the amino acid sequence of SEQ ID NO: 1466 (sequence of the IR-104 antibody H-chain CDR3) as CDR3 of (547) is a VH comprising the amino acid sequence of SEQ ID NO: 2654 (sequence of the IR-104 antibody VH).

An example of the VL in the above-mentioned L chain having the amino acid sequence of SEQ ID NO: 1468 (sequence of the IR-104 antibody L-chain CDR1) as CDR1, the amino acid sequence of SEQ ID NO: 1470 (sequence of the IR-104 antibody L-chain CDR2) as CDR2, and the amino acid sequence of SEQ ID NO: 1472 (sequence of the IR-104 antibody L-chain CDR3) as CDR3 of (548) is a VL comprising the amino acid sequence of SEQ ID NO: 1460, more preferably, a VL comprising the amino acid sequence of SEQ ID NO: 2656 (sequence of the IR-104 antibody VL).

IR-105 antibody:

An example of the VH in the above-mentioned H chain having the amino acid sequence of SEQ ID NO: 1478 (sequence of the IR-105 antibody H-chain CDR1) as CDR1, the amino acid sequence of SEQ ID NO: 1480 (sequence of the IR-105 antibody H-chain CDR2) as CDR2, and the amino acid sequence of SEQ ID NO: 1482 (sequence of the IR-105 antibody H-chain CDR3) as CDR3 of (553) is a VH comprising the amino acid sequence of SEQ ID NO: 2658 (sequence of the IR-105 antibody VH).

An example of the VL in the above-mentioned L chain having the amino acid sequence of SEQ ID NO: 1484 (sequence of the IR-105 antibody L-chain CDR1) as CDR1, the amino acid sequence of SEQ ID NO: 1486 (sequence of the IR-105 antibody L-chain CDR2) as CDR2, and the amino acid sequence of SEQ ID NO: 1488 (sequence of the IR-105 antibody L-chain CDR3) as CDR3 of (554) is a VL comprising the amino acid sequence of SEQ ID NO: 1476, more preferably, a VL comprising the amino acid sequence of SEQ ID NO: 2660 (sequence of the IR-105 antibody VL).

IR-106 antibody:

An example of the VH in the above-mentioned H chain having the amino acid sequence of SEQ ID NO: 1494 (sequence of the IR-106 antibody H-chain CDR1) as CDR1, the amino acid sequence of SEQ ID NO: 1496 (sequence of the IR-106 antibody H-chain CDR2) as CDR2, and the amino acid sequence of SEQ ID NO: 1498 (sequence of the IR-106 antibody H-chain CDR3) as CDR3 of (559) is a VH comprising the amino acid sequence of SEQ ID NO: 2662 (sequence of the IR-106 antibody VH).

An example of the VL in the above-mentioned L chain having the amino acid sequence of SEQ ID NO: 1500 (sequence of the IR-106 antibody L-chain CDR1) as CDR1, the amino acid sequence of SEQ ID NO: 1502 (sequence of the IR-106 antibody L-chain CDR2) as CDR2, and the amino acid sequence of SEQ ID NO: 1504 (sequence of the IR-106 antibody L-chain CDR3) as CDR3 of (560) is a VL comprising the amino acid sequence of SEQ ID NO: 1492, more preferably, a VL comprising the amino acid sequence of SEQ ID NO: 2664 (sequence of the IR-106 antibody VL).

IR-107 antibody:

An example of the VH in the above-mentioned H chain having the amino acid sequence of SEQ ID NO: 1510 (sequence of the IR-107 antibody H-chain CDR1) as CDR1, the amino acid sequence of SEQ ID NO: 1512 (sequence of the IR-107 antibody H-chain CDR2) as CDR2, and the amino acid sequence of SEQ ID NO: 1514 (sequence of the IR-107 antibody H-chain CDR3) as CDR3 of (565) is a VH comprising the amino acid sequence of SEQ ID NO: 2666 (sequence of the IR-107 antibody VH).

An example of the VL in the above-mentioned L chain having the amino acid sequence of SEQ ID NO: 1516 (sequence of the IR-107 antibody L-chain CDR1) as CDR1, the amino acid sequence of SEQ ID NO: 1518 (sequence of the IR-107 antibody L-chain CDR2) as CDR2, and the amino acid sequence of SEQ ID NO: 1520 (sequence of the IR-107 antibody L-chain CDR3) as CDR3 of (566) is a VL comprising the amino acid sequence of SEQ ID NO: 1508, more preferably, a VL comprising the amino acid sequence of SEQ ID NO: 2668 (sequence of the IR-107 antibody VL).

IR-108 antibody:

An example of the VH in the above-mentioned H chain having the amino acid sequence of SEQ ID NO: 1526 (sequence of the IR-108 antibody H-chain CDR1) as CDR1, the amino acid sequence of SEQ ID NO: 1528 (sequence of the IR-108 antibody H-chain CDR2) as CDR2, and the amino acid sequence of SEQ ID NO: 1530 (sequence of the IR-108 antibody H-chain CDR3) as CDR3 of (571) is a VH comprising the amino acid sequence of SEQ ID NO: 2670 (sequence of the IR-108 antibody VH)

An example of the VL in the above-mentioned L chain having the amino acid sequence of SEQ ID NO: 1532 (sequence of the IR-108 antibody L-chain CDR1) as CDR1, the amino acid sequence of SEQ ID NO: 1534 (sequence of the IR-108 antibody L-chain CDR2) as CDR2, and the amino acid sequence of SEQ ID NO: 1536 (sequence of the IR-108 antibody L-chain CDR3) as CDR3 of (572) is a VL comprising the amino acid sequence of SEQ ID NO: 1524, more preferably, a VL comprising the amino acid sequence of SEQ ID NO: 2672 (sequence of the IR-108 antibody VL)

IR-109 antibody:

An example of the VH in the above-mentioned H chain having the amino acid sequence of SEQ ID NO: 1542 (sequence of the IR-109 antibody H-chain CDR1) as CDR1, the amino acid sequence of SEQ ID NO: 1544 (sequence of the IR-109 antibody H-chain CDR2) as CDR2, and the amino acid sequence of SEQ ID NO: 1546 (sequence of the IR-109 antibody H-chain CDR3) as CDR3 of (577) is a VH comprising the amino acid sequence of SEQ ID NO: 2674 (sequence of the IR-109 antibody VH)

An example of the VL in the above-mentioned L chain having the amino acid sequence of SEQ ID NO: 1548 (sequence of the IR-109 antibody L-chain CDR1) as CDR1, the amino acid sequence of SEQ ID NO: 1550 (sequence of the IR-109 antibody L-chain CDR2) as CDR2, and the amino acid sequence of SEQ ID NO: 1552 (sequence of the IR-109 antibody L-chain CDR3) as CDR3 of (578) is a VL comprising the amino acid sequence of SEQ ID NO: 1540, more preferably, a VL comprising the amino acid sequence of SEQ ID NO: 2676 (sequence of the IR-109 antibody VL)

IR-110 antibody:

An example of the VH in the above-mentioned H chain having the amino acid sequence of SEQ ID NO: 1558 (sequence of the IR-110 antibody H-chain CDR1) as CDR1, the amino acid sequence of SEQ ID NO: 1560 (sequence of the IR-110 antibody H-chain CDR2) as CDR2, and the amino acid sequence of SEQ ID NO: 1562 (sequence of the IR-110 antibody H-chain CDR3) as CDR3 of (583) is a VH comprising the amino acid sequence of SEQ ID NO: 2678 (sequence of the IR-110 antibody VH)

An example of the VL in the above-mentioned L chain having the amino acid sequence of SEQ ID NO: 1564 (sequence of the IR-110 antibody L-chain CDR1) as CDR1, the amino acid sequence of SEQ ID NO: 1566 (sequence of the IR-110 antibody L-chain CDR2) as CDR2, and the amino acid sequence of SEQ ID NO: 1568 (sequence of the IR-110 antibody L-chain CDR3) as CDR3 of (584) is a VL comprising the amino acid sequence of SEQ ID NO: 1556, more preferably, a VL comprising the amino acid sequence of SEQ ID NO: 2680 (sequence of the IR-110 antibody VL)

IR-112 antibody:

An example of the VH in the above-mentioned H chain having the amino acid sequence of SEQ ID NO: 1574 (sequence of the IR-112 antibody H-chain CDR1) as CDR1, the amino acid sequence of SEQ ID NO: 1576 (sequence of the IR-112 antibody H-chain CDR2) as CDR2, and the amino acid sequence of SEQ ID NO: 1578 (sequence of the IR-112 antibody H-chain CDR3) as CDR3 of (589) is a VH comprising the amino acid sequence of SEQ ID NO: 2682 (sequence of the IR-112 antibody VH)

An example of the VL in the above-mentioned L chain having the amino acid sequence of SEQ ID NO: 1580 (sequence of the IR-112 antibody L-chain CDR1) as CDR1, the amino acid sequence of SEQ ID NO: 1582 (sequence of the IR-112 antibody L-chain CDR2) as CDR2, and the amino acid sequence of SEQ ID NO: 1584 (sequence of the IR-112 antibody L-chain CDR3) as CDR3 of (590) is a VL comprising the amino acid sequence of SEQ ID NO: 1572, more preferably, a VL comprising the amino acid sequence of SEQ ID NO: 2684 (sequence of the IR-112 antibody VL)

IR-114 antibody:

An example of the VH in the above-mentioned H chain having the amino acid sequence of SEQ ID NO: 1590 (sequence of the IR-114 antibody H-chain CDR1) as CDR1, the amino acid sequence of SEQ ID NO: 1592 (sequence of the IR-114 antibody H-chain CDR2) as CDR2, and the amino acid sequence of SEQ ID NO: 1594 (sequence of the IR-114 antibody H-chain CDR3) as CDR3 of (595) is a VH comprising the amino acid sequence of SEQ ID NO: 2686 (sequence of the IR-114 antibody VH)

An example of the VL in the above-mentioned L chain having the amino acid sequence of SEQ ID NO: 1596 (sequence of the IR-114 antibody L-chain CDR1) as CDR1, the amino acid sequence of SEQ ID NO: 1598 (sequence of the IR-114 antibody L-chain CDR2) as CDR2, and the amino acid sequence of SEQ ID NO: 1600 (sequence of the IR-114 antibody L-chain CDR3) as CDR3 of (596) is a VL comprising the amino acid sequence of SEQ ID NO: 1588, more preferably, a VL comprising the amino acid sequence of SEQ ID NO: 2688 (sequence of the IR-114 antibody VL)

IR-115 antibody:

An example of the VH in the above-mentioned H chain having the amino acid sequence of SEQ ID NO: 1606 (sequence of the IR-115 antibody H-chain CDR1) as CDR1, the amino acid sequence of SEQ ID NO: 1608 (sequence of the IR-115 antibody H-chain CDR2) as CDR2, and the amino acid sequence of SEQ ID NO: 1610 (sequence of the IR-115 antibody H-chain CDR3) as CDR3 of (601) is a VH comprising the amino acid sequence of SEQ ID NO: 2690 (sequence of the IR-115 antibody VH)

An example of the VL in the above-mentioned L chain having the amino acid sequence of SEQ ID NO: 1612 (sequence of the IR-115 antibody L-chain CDR1) as CDR1, the amino acid sequence of SEQ ID NO: 1614 (sequence of the IR-115 antibody L-chain CDR2) as CDR2, and the amino acid sequence of SEQ ID NO: 1616 (sequence of the IR-115 antibody L-chain CDR3) as CDR3 of (602) is a VL comprising the amino acid sequence of SEQ ID NO: 1604, more preferably, a VL comprising the amino acid sequence of SEQ ID NO: 2692 (sequence of the IR-115 antibody VL)

IR-116 antibody:

An example of the VH in the above-mentioned H chain having the amino acid sequence of SEQ ID NO: 1622 (sequence of the IR-116 antibody H-chain CDR1) as CDR1, the amino acid sequence of SEQ ID NO: 1624 (sequence of the IR-116 antibody H-chain CDR2) as CDR2, and the amino acid sequence of SEQ ID NO: 1626 (sequence of the IR-116 antibody H-chain CDR3) as CDR3 of (607) is a VH comprising the amino acid sequence of SEQ ID NO: 2694 (sequence of the IR-116 antibody VH)

An example of the VL in the above-mentioned L chain having the amino acid sequence of SEQ ID NO: 1628 (sequence of the IR-116 antibody L-chain CDR1) as CDR1, the amino acid sequence of SEQ ID NO: 1630 (sequence of the IR-116 antibody L-chain CDR2) as CDR2, and the amino acid sequence of SEQ ID NO: 1632 (sequence of the IR-116 antibody L-chain CDR3) as CDR3 of (608) is a VL comprising the amino acid sequence of SEQ ID NO: 1620, more preferably, a VL comprising the amino acid sequence of SEQ ID NO: 2696 (sequence of the IR-116 antibody VL)

IR-117 antibody:

An example of the VH in the above-mentioned H chain having the amino acid sequence of SEQ ID NO: 1638 (sequence of the IR-117 antibody H-chain CDR1) as CDR1, the amino acid sequence of SEQ ID NO: 1640 (sequence of the IR-117 antibody H-chain CDR2) as CDR2, and the amino acid sequence of SEQ ID NO: 1642 (sequence of the IR-117 antibody H-chain CDR3) as CDR3 of (613) is a VH comprising the amino acid sequence of SEQ ID NO: 2698 (sequence of the IR-117 antibody VH)

An example of the VL in the above-mentioned L chain having the amino acid sequence of SEQ ID NO: 1644 (sequence of the IR-117 antibody L-chain CDR1) as CDR1, the amino acid sequence of SEQ ID NO: 1646 (sequence of the IR-117 antibody L-chain CDR2) as CDR2, and the amino acid sequence of SEQ ID NO: 1648 (sequence of the IR-117 antibody L-chain CDR3) as CDR3 of (614) is a VL comprising the amino acid sequence of SEQ ID NO: 1636, more preferably, a VL comprising the amino acid sequence of SEQ ID NO: 2700 (sequence of the IR-117 antibody VL)

IR-118 antibody:

An example of the VH in the above-mentioned H chain having the amino acid sequence of SEQ ID NO: 1654 (sequence of the IR-118 antibody H-chain CDR1) as CDR1, the amino acid sequence of SEQ ID NO: 1656 (sequence of the IR-118 antibody H-chain CDR2) as CDR2, and the amino acid sequence of SEQ ID NO: 1658 (sequence of the IR-118 antibody H-chain CDR3) as CDR3 of (619) is a VH comprising the amino acid sequence of SEQ ID NO: 2702 (sequence of the IR-118 antibody VH)

An example of the VL in the above-mentioned L chain having the amino acid sequence of SEQ ID NO: 1660 (sequence of the IR-118 antibody L-chain CDR1) as CDR1, the amino acid sequence of SEQ ID NO: 1662 (sequence of the IR-118 antibody L-chain CDR2) as CDR2, and the amino acid sequence of SEQ ID NO: 1664 (sequence of the IR-118 antibody L-chain CDR3) as CDR3 of (620) is a VL comprising the amino acid sequence of SEQ ID NO: 1652, more preferably, a VL comprising the amino acid sequence of SEQ ID NO: 2704 (sequence of the IR-118 antibody VL)

IR-119 antibody:

An example of the VH in the above-mentioned H chain having the amino acid sequence of SEQ ID NO: 1670 (sequence of the IR-119 antibody H-chain CDR1) as CDR1, the amino acid sequence of SEQ ID NO: 1672 (sequence of the IR-119 antibody H-chain CDR2) as CDR2, and the amino acid sequence of SEQ ID NO: 1674 (sequence of the IR-119 antibody H-chain CDR3) as CDR3 of (625) is a VH comprising the amino acid sequence of SEQ ID NO: 2706 (sequence of the IR-119 antibody VH)

An example of the VL in the above-mentioned L chain having the amino acid sequence of SEQ ID NO: 1676 (sequence of the IR-119 antibody L-chain CDR1) as CDR1, the amino acid sequence of SEQ ID NO: 1678 (sequence of the IR-119 antibody L-chain CDR2) as CDR2, and the amino acid sequence of SEQ ID NO: 1680 (sequence of the IR-119 antibody L-chain CDR3) as CDR3 of (626) is a VL comprising the amino acid sequence of SEQ ID NO: 1668, more preferably, a VL comprising the amino acid sequence of SEQ ID NO: 2708 (sequence of the IR-119 antibody VL)

IR-120 antibody:

An example of the VH in the above-mentioned H chain having the amino acid sequence of SEQ ID NO: 1686 (sequence of the IR-120 antibody H-chain CDR1) as CDR1, the amino acid sequence of SEQ ID NO: 1688 (sequence of the IR-120 antibody H-chain CDR2) as CDR2, and the amino acid sequence of SEQ ID NO: 1690 (sequence of the IR-120 antibody H-chain CDR3) as CDR3 of (631) is a VH comprising the amino acid sequence of SEQ ID NO: 2710 (sequence of the IR-120 antibody VH)

An example of the VL in the above-mentioned L chain having the amino acid sequence of SEQ ID NO: 1692 (sequence of the IR-120 antibody L-chain CDR1) as CDR1, the amino acid sequence of SEQ ID NO: 1694 (sequence of the IR-120 antibody L-chain CDR2) as CDR2, and the amino acid sequence of SEQ ID NO: 1696 (sequence of the IR-120 antibody L-chain CDR3) as CDR3 of (632) is a VL comprising the amino acid sequence of SEQ ID NO: 1684, more preferably, a VL comprising the amino acid sequence of SEQ ID NO: 2712 (sequence of the IR-120 antibody VL)

IR-121 antibody:

An example of the VH in the above-mentioned H chain having the amino acid sequence of SEQ ID NO: 1702 (sequence of the IR-121 antibody H-chain CDR1) as CDR1, the amino acid sequence of SEQ ID NO: 1704 (sequence of the IR-121 antibody H-chain CDR2) as CDR2, and the amino acid sequence of SEQ ID NO: 1706 (sequence of the IR-121 antibody H-chain CDR3) as CDR3 of (637) is a VH comprising the amino acid sequence of SEQ ID NO: 2714 (sequence of the IR-121 antibody VH)

An example of the VL in the above-mentioned L chain having the amino acid sequence of SEQ ID NO: 1708 (sequence of the IR-121 antibody L-chain CDR1) as CDR1, the amino acid sequence of SEQ ID NO: 1710 (sequence of the IR-121 antibody L-chain CDR2) as CDR2, and the amino acid sequence of SEQ ID NO: 1712 (sequence of the IR-121 antibody L-chain CDR3) as CDR3 of (638) is a VL comprising the amino acid sequence of SEQ ID NO: 1700, more preferably, a VL comprising the amino acid sequence of SEQ ID NO: 2716 (sequence of the IR-121 antibody VL)

IR-122 antibody:

An example of the VH in the above-mentioned H chain having the amino acid sequence of SEQ ID NO: 1718 (sequence of the IR-122 antibody H-chain CDR1) as CDR1, the amino acid sequence of SEQ ID NO: 1720 (sequence of the IR-122 antibody H-chain CDR2) as CDR2, and the amino acid sequence of SEQ ID NO: 1722 (sequence of the IR-122 antibody H-chain CDR3) as CDR3 of (643) is a VH comprising the amino acid sequence of SEQ ID NO: 2718 (sequence of the IR-122 antibody VH)

An example of the VL in the above-mentioned L chain having the amino acid sequence of SEQ ID NO: 1724 (sequence of the IR-122 antibody L-chain CDR1) as CDR1, the amino acid sequence of SEQ ID NO: 1726 (sequence of the IR-122 antibody L-chain CDR2) as CDR2, and the amino acid sequence of SEQ ID NO: 1728 (sequence of the IR-122 antibody L-chain CDR3) as CDR3 of (644) is a VL comprising the amino acid sequence of SEQ ID NO: 1716, more preferably, a VL comprising the amino acid sequence of SEQ ID NO: 2720 (sequence of the IR-122 antibody VL)

IR-123 antibody:

An example of the VH in the above-mentioned H chain having the amino acid sequence of SEQ ID NO: 1734 (sequence of the IR-123 antibody H-chain CDR1) as CDR1, the amino acid sequence of SEQ ID NO: 1736 (sequence of the IR-123 antibody H-chain CDR2) as CDR2, and the amino acid sequence of SEQ ID NO: 1738 (sequence of the IR-123 antibody H-chain CDR3) as CDR3 of (649) is a VH comprising the amino acid sequence of SEQ ID NO: 2722 (sequence of the IR-123 antibody VH)

An example of the VL in the above-mentioned L chain having the amino acid sequence of SEQ ID NO: 1740 (sequence of the IR-123 antibody L-chain CDR1) as CDR1, the amino acid sequence of SEQ ID NO: 1742 (sequence of the

201

IR-123 antibody L-chain CDR2) as CDR2, and the amino acid sequence of SEQ ID NO: 1744 (sequence of the IR-123 antibody L-chain CDR3) as CDR3 of (650) is a VL comprising the amino acid sequence of SEQ ID NO: 1732, more preferably, a VL comprising the amino acid sequence of SEQ ID NO: 2724 (sequence of the IR-123 antibody VL)

IR-124 antibody:
An example of the VH in the above-mentioned H chain having the amino acid sequence of SEQ ID NO: 1750 (sequence of the IR-124 antibody H-chain CDR1) as CDR1, the amino acid sequence of SEQ ID NO: 1752 (sequence of the IR-124 antibody H-chain CDR2) as CDR2, and the amino acid sequence of SEQ ID NO: 1754 (sequence of the IR-124 antibody H-chain CDR3) as CDR3 of (655) is a VH comprising the amino acid sequence of SEQ ID NO: 2726 (sequence of the IR-124 antibody VH)

An example of the VL in the above-mentioned L chain having the amino acid sequence of SEQ ID NO: 1756 (sequence of the IR-124 antibody L-chain CDR1) as CDR1, the amino acid sequence of SEQ ID NO: 1758 (sequence of the IR-124 antibody L-chain CDR2) as CDR2, and the amino acid sequence of SEQ ID NO: 1760 (sequence of the IR-124 antibody L-chain CDR3) as CDR3 of (656) is a VL comprising the amino acid sequence of SEQ ID NO: 1748, more preferably, a VL comprising the amino acid sequence of SEQ ID NO: 2728 (sequence of the IR-124 antibody VL)

IR-125 antibody:
An example of the VH in the above-mentioned H chain having the amino acid sequence of SEQ ID NO: 1766 (sequence of the IR-125 antibody H-chain CDR1) as CDR1, the amino acid sequence of SEQ ID NO: 1768 (sequence of the IR-125 antibody H-chain CDR2) as CDR2, and the amino acid sequence of SEQ ID NO: 1770 (sequence of the IR-125 antibody H-chain CDR3) as CDR3 of (661) is a VH comprising the amino acid sequence of SEQ ID NO: 2730 (sequence of the IR-125 antibody VH)

An example of the VL in the above-mentioned L chain having the amino acid sequence of SEQ ID NO: 1772 (sequence of the IR-125 antibody L-chain CDR1) as CDR1, the amino acid sequence of SEQ ID NO: 1774 (sequence of the IR-125 antibody L-chain CDR2) as CDR2, and the amino acid sequence of SEQ ID NO: 1776 (sequence of the IR-125 antibody L-chain CDR3) as CDR3 of (662) is a VL comprising the amino acid sequence of SEQ ID NO: 1764, more preferably, a VL comprising the amino acid sequence of SEQ ID NO: 2732 (sequence of the IR-125 antibody VL)

IR-126 antibody:
An example of the VH in the above-mentioned H chain having the amino acid sequence of SEQ ID NO: 1782 (sequence of the IR-126 antibody H-chain CDR1) as CDR1, the amino acid sequence of SEQ ID NO: 1784 (sequence of the IR-126 antibody H-chain CDR2) as CDR2, and the amino acid sequence of SEQ ID NO: 1786 (sequence of the IR-126 antibody H-chain CDR3) as CDR3 of (667) is a VH comprising the amino acid sequence of SEQ ID NO: 2734 (sequence of the IR-126 antibody VH)

An example of the VL in the above-mentioned L chain having the amino acid sequence of SEQ ID NO: 1788 (sequence of the IR-126 antibody L-chain CDR1) as CDR1, the amino acid sequence of SEQ ID NO: 1790 (sequence of the IR-126 antibody L-chain CDR2) as CDR2, and the amino acid sequence of SEQ ID NO: 1792 (sequence of the IR-126 antibody L-chain CDR3) as CDR3 of (668) is a VL comprising the amino acid sequence of SEQ ID NO: 1780, more preferably, a VL comprising the amino acid sequence of SEQ ID NO: 2736 (sequence of the IR-126 antibody VL)

202

IR-127 antibody:
An example of the VH in the above-mentioned H chain having the amino acid sequence of SEQ ID NO: 1798 (sequence of the IR-127 antibody H-chain CDR1) as CDR1, the amino acid sequence of SEQ ID NO: 1800 (sequence of the IR-127 antibody H-chain CDR2) as CDR2, and the amino acid sequence of SEQ ID NO: 1802 (sequence of the IR-127 antibody H-chain CDR3) as CDR3 of (673) is a VH comprising the amino acid sequence of SEQ ID NO: 2738 (sequence of the IR-127 antibody VH)

An example of the VL in the above-mentioned L chain having the amino acid sequence of SEQ ID NO: 1804 (sequence of the IR-127 antibody L-chain CDR1) as CDR1, the amino acid sequence of SEQ ID NO: 1806 (sequence of the IR-127 antibody L-chain CDR2) as CDR2, and the amino acid sequence of SEQ ID NO: 1808 (sequence of the IR-127 antibody L-chain CDR3) as CDR3 of (674) is a VL comprising the amino acid sequence of SEQ ID NO: 1796, more preferably, a VL comprising the amino acid sequence of SEQ ID NO: 2740 (sequence of the IR-127 antibody VL)

IR-128 antibody:
An example of the VH in the above-mentioned H chain having the amino acid sequence of SEQ ID NO: 1814 (sequence of the IR-128 antibody H-chain CDR1) as CDR1, the amino acid sequence of SEQ ID NO: 1816 (sequence of the IR-128 antibody H-chain CDR2) as CDR2, and the amino acid sequence of SEQ ID NO: 1818 (sequence of the IR-128 antibody H-chain CDR3) as CDR3 of (679) is a VH comprising the amino acid sequence of SEQ ID NO: 2742 (sequence of the IR-128 antibody VH)

An example of the VL in the above-mentioned L chain having the amino acid sequence of SEQ ID NO: 1820 (sequence of the IR-128 antibody L-chain CDR1) as CDR1, the amino acid sequence of SEQ ID NO: 1822 (sequence of the IR-128 antibody L-chain CDR2) as CDR2, and the amino acid sequence of SEQ ID NO: 1824 (sequence of the IR-128 antibody L-chain CDR3) as CDR3 of (680) is a VL comprising the amino acid sequence of SEQ ID NO: 1812, more preferably, a VL comprising the amino acid sequence of SEQ ID NO: 2744 (sequence of the IR-128 antibody VL)

IR-129 antibody:
An example of the VH in the above-mentioned H chain having the amino acid sequence of SEQ ID NO: 1830 (sequence of the IR-129 antibody H-chain CDR1) as CDR1, the amino acid sequence of SEQ ID NO: 1832 (sequence of the IR-129 antibody H-chain CDR2) as CDR2, and the amino acid sequence of SEQ ID NO: 1834 (sequence of the IR-129 antibody H-chain CDR3) as CDR3 of (685) is a VH comprising the amino acid sequence of SEQ ID NO: 2746 (sequence of the IR-129 antibody VH)

An example of the VL in the above-mentioned L chain having the amino acid sequence of SEQ ID NO: 1836 (sequence of the IR-129 antibody L-chain CDR1) as CDR1, the amino acid sequence of SEQ ID NO: 1838 (sequence of the IR-129 antibody L-chain CDR2) as CDR2, and the amino acid sequence of SEQ ID NO: 1840 (sequence of the IR-129 antibody L-chain CDR3) as CDR3 of (686) is a VL comprising the amino acid sequence of SEQ ID NO: 1828, more preferably, a VL comprising the amino acid sequence of SEQ ID NO: 2748 (sequence of the IR-129 antibody VL)

IR-131 antibody:
An example of the VH in the above-mentioned H chain having the amino acid sequence of SEQ ID NO: 1846 (sequence of the IR-131 antibody H-chain CDR1) as CDR1, the amino acid sequence of SEQ ID NO: 1848 (sequence of the IR-131 antibody H-chain CDR2) as CDR2, and the amino acid sequence of SEQ ID NO: 1850 (sequence of the IR-131 antibody H-chain CDR3) as CDR3 of (691) is a VH comprising the amino acid sequence of SEQ ID NO: 2750 (sequence of the IR-131 antibody VH)

An example of the VL in the above-mentioned L chain having the amino acid sequence of SEQ ID NO: 1852 (sequence of the IR-131 antibody L-chain CDR1) as CDR1, the amino acid sequence of SEQ ID NO: 1854 (sequence of the IR-131 antibody L-chain CDR2) as CDR2, and the amino acid sequence of SEQ ID NO: 1856 (sequence of the IR-131 antibody L-chain CDR3) as CDR3 of (692) is a VL comprising the amino acid sequence of SEQ ID NO: 1844, more preferably, a VL comprising the amino acid sequence of SEQ ID NO: 2752 (sequence of the IR-131 antibody VL)

IR-132 antibody:

An example of the VH in the above-mentioned H chain having the amino acid sequence of SEQ ID NO: 1862 (sequence of the IR-132 antibody H-chain CDR1) as CDR1, the amino acid sequence of SEQ ID NO: 1864 (sequence of the IR-132 antibody H-chain CDR2) as CDR2, and the amino acid sequence of SEQ ID NO: 1866 (sequence of the IR-132 antibody H-chain CDR3) as CDR3 of (697) is a VH comprising the amino acid sequence of SEQ ID NO: 2754 (sequence of the IR-132 antibody VH)

An example of the VL in the above-mentioned L chain having the amino acid sequence of SEQ ID NO: 1868 (sequence of the IR-132 antibody L-chain CDR1) as CDR1, the amino acid sequence of SEQ ID NO: 1870 (sequence of the IR-132 antibody L-chain CDR2) as CDR2, and the amino acid sequence of SEQ ID NO: 1872 (sequence of the IR-132 antibody L-chain CDR3) as CDR3 of (698) is a VL comprising the amino acid sequence of SEQ ID NO: 1860, more preferably, a VL comprising the amino acid sequence of SEQ ID NO: 2756 (sequence of the IR-132 antibody VL)

IR-133 antibody:

An example of the VH in the above-mentioned H chain having the amino acid sequence of SEQ ID NO: 1878 (sequence of the IR-133 antibody H-chain CDR1) as CDR1, the amino acid sequence of SEQ ID NO: 1880 (sequence of the IR-133 antibody H-chain CDR2) as CDR2, and the amino acid sequence of SEQ ID NO: 1882 (sequence of the IR-133 antibody H-chain CDR3) as CDR3 of (703) is a VH comprising the amino acid sequence of SEQ ID NO: 2758 (sequence of the IR-133 antibody VH)

An example of the VL in the above-mentioned L chain having the amino acid sequence of SEQ ID NO: 1884 (sequence of the IR-133 antibody L-chain CDR1) as CDR1, the amino acid sequence of SEQ ID NO: 1886 (sequence of the IR-133 antibody L-chain CDR2) as CDR2, and the amino acid sequence of SEQ ID NO: 1888 (sequence of the IR-133 antibody L-chain CDR3) as CDR3 of (704) is a VL comprising the amino acid sequence of SEQ ID NO: 1876, more preferably, a VL comprising the amino acid sequence of SEQ ID NO: 2760 (sequence of the IR-133 antibody VL)

IR-134 antibody:

An example of the VH in the above-mentioned H chain having the amino acid sequence of SEQ ID NO: 1894 (sequence of the IR-134 antibody H-chain CDR1) as CDR1, the amino acid sequence of SEQ ID NO: 1896 (sequence of the IR-134 antibody H-chain CDR2) as CDR2, and the amino acid sequence of SEQ ID NO: 1898 (sequence of the IR-134 antibody H-chain CDR3) as CDR3 of (709) is a VH comprising the amino acid sequence of SEQ ID NO: 2762 (sequence of the IR-134 antibody VH)

An example of the VL in the above-mentioned L chain having the amino acid sequence of SEQ ID NO: 1900 (sequence of the IR-134 antibody L-chain CDR1) as CDR1, the amino acid sequence of SEQ ID NO: 1902 (sequence of the IR-134 antibody L-chain CDR2) as CDR2, and the amino acid sequence of SEQ ID NO: 1904 (sequence of the IR-134 antibody L-chain CDR3) as CDR3 of (710) is a VL comprising the amino acid sequence of SEQ ID NO: 1892, more preferably, a VL comprising the amino acid sequence of SEQ ID NO: 2764 (sequence of the IR-134 antibody VL)

IR-135 antibody:

An example of the VH in the above-mentioned H chain having the amino acid sequence of SEQ ID NO: 1910 (sequence of the IR-135 antibody H-chain CDR1) as CDR1, the amino acid sequence of SEQ ID NO: 1912 (sequence of the IR-135 antibody H-chain CDR2) as CDR2, and the amino acid sequence of SEQ ID NO: 1914 (sequence of the IR-135 antibody H-chain CDR3) as CDR3 of (715) is a VH comprising the amino acid sequence of SEQ ID NO: 1906, more preferably, a VH comprising the amino acid sequence of SEQ ID NO: 2766 (sequence of the IR-135 antibody VH)

An example of the VL in the above-mentioned L chain having the amino acid sequence of SEQ ID NO: 1916 (sequence of the IR-135 antibody L-chain CDR1) as CDR1, the amino acid sequence of SEQ ID NO: 1918 (sequence of the IR-135 antibody L-chain CDR2) as CDR2, and the amino acid sequence of SEQ ID NO: 1920 (sequence of the IR-135 antibody L-chain CDR3) as CDR3 of (716) is a VL comprising the amino acid sequence of SEQ ID NO: 1908, more preferably, a VL comprising the amino acid sequence of SEQ ID NO: 2768 (sequence of the IR-135 antibody VL)

IR-136 antibody:

An example of the VH in the above-mentioned H chain having the amino acid sequence of SEQ ID NO: 1926 (sequence of the IR-136 antibody H-chain CDR1) as CDR1, the amino acid sequence of SEQ ID NO: 1928 (sequence of the IR-136 antibody H-chain CDR2) as CDR2, and the amino acid sequence of SEQ ID NO: 1930 (sequence of the IR-136 antibody H-chain CDR3) as CDR3 of (721) is a VH comprising the amino acid sequence of SEQ ID NO: 2770 (sequence of the IR-136 antibody VH)

An example of the VL in the above-mentioned L chain having the amino acid sequence of SEQ ID NO: 1932 (sequence of the IR-136 antibody L-chain CDR1) as CDR1, the amino acid sequence of SEQ ID NO: 1934 (sequence of the IR-136 antibody L-chain CDR2) as CDR2, and the amino acid sequence of SEQ ID NO: 1936 (sequence of the IR-136 antibody L-chain CDR3) as CDR3 of (722) is a VL comprising the amino acid sequence of SEQ ID NO: 1924, more preferably, a VL comprising the amino acid sequence of SEQ ID NO: 2772 (sequence of the IR-136 antibody VL)

IR-137 antibody:

An example of the VH in the above-mentioned H chain having the amino acid sequence of SEQ ID NO: 1942 (sequence of the IR-137 antibody H-chain CDR1) as CDR1, the amino acid sequence of SEQ ID NO: 1944 (sequence of the IR-137 antibody H-chain CDR2) as CDR2, and the amino acid sequence of SEQ ID NO: 1946 (sequence of the IR-137 antibody H-chain CDR3) as CDR3 of (727) is a VH comprising the amino acid sequence of SEQ ID NO: 2774 (sequence of the IR-137 antibody VH)

An example of the VL in the above-mentioned L chain having the amino acid sequence of SEQ ID NO: 1948 (sequence of the IR-137 antibody L-chain CDR1) as CDR1, the amino acid sequence of SEQ ID NO: 1950 (sequence of the IR-137 antibody L-chain CDR2) as CDR2, and the amino acid sequence of SEQ ID NO: 1952 (sequence of the IR-137 antibody L-chain CDR3) as CDR3 of (728) is a VL comprising the amino acid sequence of SEQ ID NO: 1940, more preferably, a VL comprising the amino acid sequence of SEQ ID NO: 2776 (sequence of the IR-137 antibody VL)

IR-138 antibody:

An example of the VH in the above-mentioned H chain having the amino acid sequence of SEQ ID NO: 1958 (sequence of the IR-138 antibody H-chain CDR1) as CDR1, the amino acid sequence of SEQ ID NO: 1960 (sequence of the IR-138 antibody H-chain CDR2) as CDR2, and the amino acid sequence of SEQ ID NO: 1962 (sequence of the IR-138 antibody H-chain CDR3) as CDR3 of (733) is a VH comprising the amino acid sequence of SEQ ID NO: 2778 (sequence of the IR-138 antibody VH)

An example of the VL in the above-mentioned L chain having the amino acid sequence of SEQ ID NO: 1964 (sequence of the IR-138 antibody L-chain CDR1) as CDR1, the amino acid sequence of SEQ ID NO: 1966 (sequence of the IR-138 antibody L-chain CDR2) as CDR2, and the amino acid sequence of SEQ ID NO: 1968 (sequence of the IR-138 antibody L-chain CDR3) as CDR3 of (734) is a VL comprising the amino acid sequence of SEQ ID NO: 1956, more preferably, a VL comprising the amino acid sequence of SEQ ID NO: 2780 (sequence of the IR-138 antibody VL)

IR-139 antibody:

An example of the VH in the above-mentioned H chain having the amino acid sequence of SEQ ID NO: 1974 (sequence of the IR-139 antibody H-chain CDR1) as CDR1, the amino acid sequence of SEQ ID NO: 1976 (sequence of the IR-139 antibody H-chain CDR2) as CDR2, and the amino acid sequence of SEQ ID NO: 1978 (sequence of the IR-139 antibody H-chain CDR3) as CDR3 of (739) is a VH comprising the amino acid sequence of SEQ ID NO: 2782 (sequence of the IR-139 antibody VH)

An example of the VL in the above-mentioned L chain having the amino acid sequence of SEQ ID NO: 1980 (sequence of the IR-139 antibody L-chain CDR1) as CDR1, the amino acid sequence of SEQ ID NO: 1982 (sequence of the IR-139 antibody L-chain CDR2) as CDR2, and the amino acid sequence of SEQ ID NO: 1984 (sequence of the IR-139 antibody L-chain CDR3) as CDR3 of (740) is a VL comprising the amino acid sequence of SEQ ID NO: 1972, more preferably, a VL comprising the amino acid sequence of SEQ ID NO: 2784 (sequence of the IR-139 antibody VL)

IR-140 antibody:

An example of the VH in the above-mentioned H chain having the amino acid sequence of SEQ ID NO: 1990 (sequence of the IR-140 antibody H-chain CDR1) as CDR1, the amino acid sequence of SEQ ID NO: 1992 (sequence of the IR-140 antibody H-chain CDR2) as CDR2, and the amino acid sequence of SEQ ID NO: 1994 (sequence of the IR-140 antibody H-chain CDR3) as CDR3 of (745) is a VH comprising the amino acid sequence of SEQ ID NO: 2786 (sequence of the IR-140 antibody VH)

An example of the VL in the above-mentioned L chain having the amino acid sequence of SEQ ID NO: 1996 (sequence of the IR-140 antibody L-chain CDR1) as CDR1, the amino acid sequence of SEQ ID NO: 1998 (sequence of the IR-140 antibody L-chain CDR2) as CDR2, and the amino acid sequence of SEQ ID NO: 2000 (sequence of the IR-140 antibody L-chain CDR3) as CDR3 of (746) is a VL comprising the amino acid sequence of SEQ ID NO: 1988, more preferably, a VL comprising the amino acid sequence of SEQ ID NO: 2788 (sequence of the IR-140 antibody VL)

IR-141 antibody:

An example of the VH in the above-mentioned H chain having the amino acid sequence of SEQ ID NO: 2006 (sequence of the IR-141 antibody H-chain CDR1) as CDR1, the amino acid sequence of SEQ ID NO: 2008 (sequence of the IR-141 antibody H-chain CDR2) as CDR2, and the amino acid sequence of SEQ ID NO: 2010 (sequence of the IR-141 antibody H-chain CDR3) as CDR3 of (751) is a VH comprising the amino acid sequence of SEQ ID NO: 2790 (sequence of the IR-141 antibody VH)

An example of the VL in the above-mentioned L chain having the amino acid sequence of SEQ ID NO: 2012 (sequence of the IR-141 antibody L-chain CDR1) as CDR1, the amino acid sequence of SEQ ID NO: 2014 (sequence of the IR-141 antibody L-chain CDR2) as CDR2, and the amino acid sequence of SEQ ID NO: 2016 (sequence of the IR-141 antibody L-chain CDR3) as CDR3 of (752) is a VL comprising the amino acid sequence of SEQ ID NO: 2004, more preferably, a VL comprising the amino acid sequence of SEQ ID NO: 2792 (sequence of the IR-141 antibody VL)

IR-142 antibody:

An example of the VH in the above-mentioned H chain having the amino acid sequence of SEQ ID NO: 2022 (sequence of the IR-142 antibody H-chain CDR1) as CDR1, the amino acid sequence of SEQ ID NO: 2024 (sequence of the IR-142 antibody H-chain CDR2) as CDR2, and the amino acid sequence of SEQ ID NO: 2026 (sequence of the IR-142 antibody H-chain CDR3) as CDR3 of (757) is a VH comprising the amino acid sequence of SEQ ID NO: 2794 (sequence of the IR-142 antibody VH)

An example of the VL in the above-mentioned L chain having the amino acid sequence of SEQ ID NO: 2028 (sequence of the IR-142 antibody L-chain CDR1) as CDR1, the amino acid sequence of SEQ ID NO: 2030 (sequence of the IR-142 antibody L-chain CDR2) as CDR2, and the amino acid sequence of SEQ ID NO: 2032 (sequence of the IR-142 antibody L-chain CDR3) as CDR3 of (758) is a VL comprising the amino acid sequence of SEQ ID NO: 2020, more preferably, a VL comprising the amino acid sequence of SEQ ID NO: 2796 (sequence of the IR-142 antibody VL)

IR-143 antibody:

An example of the VH in the above-mentioned H chain having the amino acid sequence of SEQ ID NO: 2038 (sequence of the IR-143 antibody H-chain CDR1) as CDR1, the amino acid sequence of SEQ ID NO: 2040 (sequence of the IR-143 antibody H-chain CDR2) as CDR2, and the amino acid sequence of SEQ ID NO: 2042 (sequence of the IR-143 antibody H-chain CDR3) as CDR3 of (763) is a VH comprising the amino acid sequence of SEQ ID NO: 2798 (sequence of the IR-143 antibody VH)

An example of the VL in the above-mentioned L chain having the amino acid sequence of SEQ ID NO: 2044 (sequence of the IR-143 antibody L-chain CDR1) as CDR1, the amino acid sequence of SEQ ID NO: 2046 (sequence of the IR-143 antibody L-chain CDR2) as CDR2, and the amino acid sequence of SEQ ID NO: 2048 (sequence of the IR-143 antibody L-chain CDR3) as CDR3 of (764) is a VL comprising the amino acid sequence of SEQ ID NO: 2036, more preferably, a VL comprising the amino acid sequence of SEQ ID NO: 2800 (sequence of the IR-143 antibody VL)

IR-144 antibody:

An example of the VH in the above-mentioned H chain having the amino acid sequence of SEQ ID NO: 2054 (sequence of the IR-144 antibody H-chain CDR1) as CDR1, the amino acid sequence of SEQ ID NO: 2056 (sequence of the IR-144 antibody H-chain CDR2) as CDR2, and the amino acid sequence of SEQ ID NO: 2058 (sequence of the IR-144 antibody H-chain CDR3) as CDR3 of (769) is a VH comprising the amino acid sequence of SEQ ID NO: 2802 (sequence of the IR-144 antibody VH)

An example of the VL in the above-mentioned L chain having the amino acid sequence of SEQ ID NO: 2060 (sequence of the IR-144 antibody L-chain CDR1) as CDR1, the amino acid sequence of SEQ ID NO: 2062 (sequence of the IR-144 antibody L-chain CDR2) as CDR2, and the amino acid sequence of SEQ ID NO: 2064 (sequence of the IR-144 antibody L-chain CDR3) as CDR3 of (770) is a VL comprising the amino acid sequence of SEQ ID NO: 2052, more preferably, a VL comprising the amino acid sequence of SEQ ID NO: 2804 (sequence of the IR-144 antibody VL)

IR-145 antibody:
An example of the VH in the above-mentioned H chain having the amino acid sequence of SEQ ID NO: 2070 (sequence of the IR-145 antibody H-chain CDR1) as CDR1, the amino acid sequence of SEQ ID NO: 2072 (sequence of the IR-145 antibody H-chain CDR2) as CDR2, and the amino acid sequence of SEQ ID NO: 2074 (sequence of the IR-145 antibody H-chain CDR3) as CDR3 of (775) is a VH comprising the amino acid sequence of SEQ ID NO: 2806 (sequence of the IR-145 antibody VH)

An example of the VL in the above-mentioned L chain having the amino acid sequence of SEQ ID NO: 2076 (sequence of the IR-145 antibody L-chain CDR1) as CDR1, the amino acid sequence of SEQ ID NO: 2078 (sequence of the IR-145 antibody L-chain CDR2) as CDR2, and the amino acid sequence of SEQ ID NO: 2080 (sequence of the IR-145 antibody L-chain CDR3) as CDR3 of (776) is a VL comprising the amino acid sequence of SEQ ID NO: 2068, more preferably, a VL comprising the amino acid sequence of SEQ ID NO: 2808 (sequence of the IR-145 antibody VL)

IR-146 antibody:
An example of the VH in the above-mentioned H chain having the amino acid sequence of SEQ ID NO: 2086 (sequence of the IR-146 antibody H-chain CDR1) as CDR1, the amino acid sequence of SEQ ID NO: 2088 (sequence of the IR-146 antibody H-chain CDR2) as CDR2, and the amino acid sequence of SEQ ID NO: 2090 (sequence of the IR-146 antibody H-chain CDR3) as CDR3 of (781) is a VH comprising the amino acid sequence of SEQ ID NO: 2810 (sequence of the IR-146 antibody VH)

An example of the VL in the above-mentioned L chain having the amino acid sequence of SEQ ID NO: 2092 (sequence of the IR-146 antibody L-chain CDR1) as CDR1, the amino acid sequence of SEQ ID NO: 2094 (sequence of the IR-146 antibody L-chain CDR2) as CDR2, and the amino acid sequence of SEQ ID NO: 2096 (sequence of the IR-146 antibody L-chain CDR3) as CDR3 of (782) is a VL comprising the amino acid sequence of SEQ ID NO: 2084, more preferably, a VL comprising the amino acid sequence of SEQ ID NO: 2812 (sequence of the IR-146 antibody VL)

IR-147 antibody:
An example of the VH in the above-mentioned H chain having the amino acid sequence of SEQ ID NO: 2102 (sequence of the IR-147 antibody H-chain CDR1) as CDR1, the amino acid sequence of SEQ ID NO: 2104 (sequence of the IR-147 antibody H-chain CDR2) as CDR2, and the amino acid sequence of SEQ ID NO: 2106 (sequence of the IR-147 antibody H-chain CDR3) as CDR3 of (787) is a VH comprising the amino acid sequence of SEQ ID NO: 2814 (sequence of the IR-147 antibody VH)

An example of the VL in the above-mentioned L chain having the amino acid sequence of SEQ ID NO: 2108 (sequence of the IR-147 antibody L-chain CDR1) as CDR1, the amino acid sequence of SEQ ID NO: 2110 (sequence of the IR-147 antibody L-chain CDR2) as CDR2, and the amino acid sequence of SEQ ID NO: 2112 (sequence of the IR-147 antibody L-chain CDR3) as CDR3 of (788) is a VL comprising the amino acid sequence of SEQ ID NO: 2100, more preferably, a VL comprising the amino acid sequence of SEQ ID NO: 2816 (sequence of the IR-147 antibody VL)

IR-149 antibody:
An example of the VH in the above-mentioned H chain having the amino acid sequence of SEQ ID NO: 2118 (sequence of the IR-149 antibody H-chain CDR1) as CDR1, the amino acid sequence of SEQ ID NO: 2120 (sequence of the IR-149 antibody H-chain CDR2) as CDR2, and the amino acid sequence of SEQ ID NO: 2122 (sequence of the IR-149 antibody H-chain CDR3) as CDR3 of (793) is a VH comprising the amino acid sequence of SEQ ID NO: 2818 (sequence of the IR-149 antibody VH)

An example of the VL in the above-mentioned L chain having the amino acid sequence of SEQ ID NO: 2124 (sequence of the IR-149 antibody L-chain CDR1) as CDR1, the amino acid sequence of SEQ ID NO: 2126 (sequence of the IR-149 antibody L-chain CDR2) as CDR2, and the amino acid sequence of SEQ ID NO: 2128 (sequence of the IR-149 antibody L-chain CDR3) as CDR3 of (794) is a VL comprising the amino acid sequence of SEQ ID NO: 2820 (sequence of the IR-149 antibody VL)

IR-150 antibody:
An example of the VH in the above-mentioned H chain having the amino acid sequence of SEQ ID NO: 2134 (sequence of the IR-150 antibody H-chain CDR1) as CDR1, the amino acid sequence of SEQ ID NO: 2136 (sequence of the IR-150 antibody H-chain CDR2) as CDR2, and the amino acid sequence of SEQ ID NO: 2138 (sequence of the IR-150 antibody H-chain CDR3) as CDR3 of (799) is a VH comprising the amino acid sequence of SEQ ID NO: 2822 (sequence of the IR-150 antibody VH)

An example of the VL in the above-mentioned L chain having the amino acid sequence of SEQ ID NO: 2140 (sequence of the IR-150 antibody L-chain CDR1) as CDR1, the amino acid sequence of SEQ ID NO: 2142 (sequence of the IR-150 antibody L-chain CDR2) as CDR2, and the amino acid sequence of SEQ ID NO: 2144 (sequence of the IR-150 antibody L-chain CDR3) as CDR3 of (800) is a VL comprising the amino acid sequence of SEQ ID NO: 2132, more preferably, a VL comprising the amino acid sequence of SEQ ID NO: 2824 (sequence of the IR-150 antibody VL)

IR-151 antibody:
An example of the VH in the above-mentioned H chain having the amino acid sequence of SEQ ID NO: 2150 (sequence of the IR-151 antibody H-chain CDR1) as CDR1, the amino acid sequence of SEQ ID NO: 2152 (sequence of the IR-151 antibody H-chain CDR2) as CDR2, and the amino acid sequence of SEQ ID NO: 2154 (sequence of the IR-151 antibody H-chain CDR3) as CDR3 of (805) is a VH comprising the amino acid sequence of SEQ ID NO: 2826 (sequence of the IR-151 antibody VH)

An example of the VL in the above-mentioned L chain having the amino acid sequence of SEQ ID NO: 2156 (sequence of the IR-151 antibody L-chain CDR1) as CDR1, the amino acid sequence of SEQ ID NO: 2158 (sequence of the IR-151 antibody L-chain CDR2) as CDR2, and the amino acid sequence of SEQ ID NO: 2160 (sequence of the IR-151 antibody L-chain CDR3) as CDR3 of (806) is a VL comprising the amino acid sequence of SEQ ID NO: 2148, more preferably, a VL comprising the amino acid sequence of SEQ ID NO: 2828 (sequence of the IR-151 antibody VL)

IR-152 antibody:
An example of the VH in the above-mentioned H chain having the amino acid sequence of SEQ ID NO: 2166 (sequence of the IR-152 antibody H-chain CDR1) as CDR1, the amino acid sequence of SEQ ID NO: 2168 (sequence of the IR-152 antibody H-chain CDR2) as CDR2, and the amino acid sequence of SEQ ID NO: 2170 (sequence of the IR-152 antibody H-chain CDR3) as CDR3 of (811) is a VH comprising the amino acid sequence of SEQ ID NO: 2830 (sequence of the IR-152 antibody VH)

An example of the VL in the above-mentioned L chain having the amino acid sequence of SEQ ID NO: 2172 (sequence of the IR-152 antibody L-chain CDR1) as CDR1, the amino acid sequence of SEQ ID NO: 2174 (sequence of the IR-152 antibody L-chain CDR2) as CDR2, and the amino acid sequence of SEQ ID NO: 2176 (sequence of the IR-152 antibody L-chain CDR3) as CDR3 of (812) is a VL comprising the amino acid sequence of SEQ ID NO: 2164, more preferably, a VL comprising the amino acid sequence of SEQ ID NO: 2832 (sequence of the IR-152 antibody VL)

IR-153 antibody:

An example of the VH in the above-mentioned H chain having the amino acid sequence of SEQ ID NO: 2182 (sequence of the IR-153 antibody H-chain CDR1) as CDR1, the amino acid sequence of SEQ ID NO: 2184 (sequence of the IR-153 antibody H-chain CDR2) as CDR2, and the amino acid sequence of SEQ ID NO: 2186 (sequence of the IR-153 antibody H-chain CDR3) as CDR3 of (817) is a VH comprising the amino acid sequence of SEQ ID NO: 2834 (sequence of the IR-153 antibody VH)

An example of the VL in the above-mentioned L chain having the amino acid sequence of SEQ ID NO: 2188 (sequence of the IR-153 antibody L-chain CDR1) as CDR1, the amino acid sequence of SEQ ID NO: 2190 (sequence of the IR-153 antibody L-chain CDR2) as CDR2, and the amino acid sequence of SEQ ID NO: 2192 (sequence of the IR-153 antibody L-chain CDR3) as CDR3 of (818) is a VL comprising the amino acid sequence of SEQ ID NO: 2180, more preferably, a VL comprising the amino acid sequence of SEQ ID NO: 2836 (sequence of the IR-153 antibody VL)

IR-154 antibody:

An example of the VH in the above-mentioned H chain having the amino acid sequence of SEQ ID NO: 2198 (sequence of the IR-154 antibody H-chain CDR1) as CDR1, the amino acid sequence of SEQ ID NO: 2200 (sequence of the IR-154 antibody H-chain CDR2) as CDR2, and the amino acid sequence of SEQ ID NO: 2202 (sequence of the IR-154 antibody H-chain CDR3) as CDR3 of (823) is a VH comprising the amino acid sequence of SEQ ID NO: 2838 (sequence of the IR-154 antibody VH)

An example of the VL in the above-mentioned L chain having the amino acid sequence of SEQ ID NO: 2204 (sequence of the IR-154 antibody L-chain CDR1) as CDR1, the amino acid sequence of SEQ ID NO: 2206 (sequence of the IR-154 antibody L-chain CDR2) as CDR2, and the amino acid sequence of SEQ ID NO: 2208 (sequence of the IR-154 antibody L-chain CDR3) as CDR3 of (824) is a VL comprising the amino acid sequence of SEQ ID NO: 2196, more preferably, a VL comprising the amino acid sequence of SEQ ID NO: 2840 (sequence of the IR-154 antibody VL)

IR-155 antibody:

An example of the VH in the above-mentioned H chain having the amino acid sequence of SEQ ID NO: 2214 (sequence of the IR-155 antibody H-chain CDR1) as CDR1, the amino acid sequence of SEQ ID NO: 2216 (sequence of the IR-155 antibody H-chain CDR2) as CDR2, and the amino acid sequence of SEQ ID NO: 2218 (sequence of the IR-155 antibody H-chain CDR3) as CDR3 of (829) is a VH comprising the amino acid sequence of SEQ ID NO: 2842 (sequence of the IR-155 antibody VH)

An example of the VL in the above-mentioned L chain having the amino acid sequence of SEQ ID NO: 2220 (sequence of the IR-155 antibody L-chain CDR1) as CDR1, the amino acid sequence of SEQ ID NO: 2222 (sequence of the IR-155 antibody L-chain CDR2) as CDR2, and the amino acid sequence of SEQ ID NO: 2224 (sequence of the IR-155 antibody L-chain CDR3) as CDR3 of (830) is a VL comprising the amino acid sequence of SEQ ID NO: 2212, more preferably, a VL comprising the amino acid sequence of SEQ ID NO: 2844 (sequence of the IR-155 antibody VL)

IR-156 antibody:

An example of the VH in the above-mentioned H chain having the amino acid sequence of SEQ ID NO: 2230 (sequence of the IR-156 antibody H-chain CDR1) as CDR1, the amino acid sequence of SEQ ID NO: 2232 (sequence of the IR-156 antibody H-chain CDR2) as CDR2, and the amino acid sequence of SEQ ID NO: 2234 (sequence of the IR-156 antibody H-chain CDR3) as CDR3 of (835) is a VH comprising the amino acid sequence of SEQ ID NO: 2846 (sequence of the IR-156 antibody VH)

An example of the VL in the above-mentioned L chain having the amino acid sequence of SEQ ID NO: 2236 (sequence of the IR-156 antibody L-chain CDR1) as CDR1, the amino acid sequence of SEQ ID NO: 2238 (sequence of the IR-156 antibody L-chain CDR2) as CDR2, and the amino acid sequence of SEQ ID NO: 2240 (sequence of the IR-156 antibody L-chain CDR3) as CDR3 of (836) is a VL comprising the amino acid sequence of SEQ ID NO: 2228, more preferably, a VL comprising the amino acid sequence of SEQ ID NO: 2848 (sequence of the IR-156 antibody VL)

IR-157 antibody:

An example of the VH in the above-mentioned H chain having the amino acid sequence of SEQ ID NO: 2246 (sequence of the IR-157 antibody H-chain CDR1) as CDR1, the amino acid sequence of SEQ ID NO: 2248 (sequence of the IR-157 antibody H-chain CDR2) as CDR2, and the amino acid sequence of SEQ ID NO: 2250 (sequence of the IR-157 antibody H-chain CDR3) as CDR3 of (841) is a VH comprising the amino acid sequence of SEQ ID NO: 2850 (sequence of the IR-157 antibody VH)

An example of the VL in the above-mentioned L chain having the amino acid sequence of SEQ ID NO: 2252 (sequence of the IR-157 antibody L-chain CDR1) as CDR1, the amino acid sequence of SEQ ID NO: 2254 (sequence of the IR-157 antibody L-chain CDR2) as CDR2, and the amino acid sequence of SEQ ID NO: 2256 (sequence of the IR-157 antibody L-chain CDR3) as CDR3 of (842) is a VL comprising the amino acid sequence of SEQ ID NO: 2244, more preferably, a VL comprising the amino acid sequence of SEQ ID NO: 2852 (sequence of the IR-157 antibody VL)

IR-158 antibody:

An example of the VH in the above-mentioned H chain having the amino acid sequence of SEQ ID NO: 2262 (sequence of the IR-158 antibody H-chain CDR1) as CDR1, the amino acid sequence of SEQ ID NO: 2264 (sequence of the IR-158 antibody H-chain CDR2) as CDR2, and the amino acid sequence of SEQ ID NO: 2266 (sequence of the IR-158 antibody H-chain CDR3) as CDR3 of (847) is a VH comprising the amino acid sequence of SEQ ID NO: 2854 (sequence of the IR-158 antibody VH)

An example of the VL in the above-mentioned L chain having the amino acid sequence of SEQ ID NO: 2268 (sequence of the IR-158 antibody L-chain CDR1) as CDR1, the amino acid sequence of SEQ ID NO: 2270 (sequence of the IR-158 antibody L-chain CDR2) as CDR2, and the amino acid sequence of SEQ ID NO: 2272 (sequence of the IR-158 antibody L-chain CDR3) as CDR3 of (848) is a VL comprising the amino acid sequence of SEQ ID NO: 2260, more preferably, a VL comprising the amino acid sequence of SEQ ID NO: 2856 (sequence of the IR-158 antibody VL)

IR-159 antibody:

An example of the VH in the above-mentioned H chain having the amino acid sequence of SEQ ID NO: 2278 (sequence of the IR-159 antibody H-chain CDR1) as CDR1, the amino acid sequence of SEQ ID NO: 2280 (sequence of the IR-159 antibody H-chain CDR2) as CDR2, and the amino acid sequence of SEQ ID NO: 2282 (sequence of the IR-159 antibody H-chain CDR3) as CDR3 of (853) is a VH comprising the amino acid sequence of SEQ ID NO: 2858 (sequence of the IR-159 antibody VH)

An example of the VL in the above-mentioned L chain having the amino acid sequence of SEQ ID NO: 2284 (sequence of the IR-159 antibody L-chain CDR1) as CDR1, the amino acid sequence of SEQ ID NO: 2286 (sequence of the IR-159 antibody L-chain CDR2) as CDR2, and the amino acid sequence of SEQ ID NO: 2288 (sequence of the IR-159 antibody L-chain CDR3) as CDR3 of (854) is a VL comprising the amino acid sequence of SEQ ID NO: 2276, more preferably, a VL comprising the amino acid sequence of SEQ ID NO: 2860 (sequence of the IR-159 antibody VL)

IR-160 antibody:

An example of the VH in the above-mentioned H chain having the amino acid sequence of SEQ ID NO: 2866 (sequence of the IR-160 antibody H-chain CDR1) as CDR1, the amino acid sequence of SEQ ID NO: 2868 (sequence of the IR-160 antibody H-chain CDR2) as CDR2, and the amino acid sequence of SEQ ID NO: 2870 (sequence of the IR-160 antibody H-chain CDR3) as CDR3 of (859) is a VH comprising the amino acid sequence of SEQ ID NO: 2862 (sequence of the IR-160 antibody VH)

An example of the VL in the above-mentioned L chain having the amino acid sequence of SEQ ID NO: 2872 (sequence of the IR-160 antibody L-chain CDR1) as CDR1, the amino acid sequence of SEQ ID NO: 2874 (sequence of the IR-160 antibody L-chain CDR2) as CDR2, and the amino acid sequence of SEQ ID NO: 2876 (sequence of the IR-160 antibody L-chain CDR3) as CDR3 of (860) is a VL comprising the amino acid sequence of SEQ ID NO: 2864 (sequence of the IR-160 antibody VL)

IR-161 antibody:

An example of the VH in the above-mentioned H chain having the amino acid sequence of SEQ ID NO: 2882 (sequence of the IR-161 antibody H-chain CDR1) as CDR1, the amino acid sequence of SEQ ID NO: 2884 (sequence of the IR-161 antibody H-chain CDR2) as CDR2, and the amino acid sequence of SEQ ID NO: 2886 (sequence of the IR-161 antibody H-chain CDR3) as CDR3 of (865) is a VH comprising the amino acid sequence of SEQ ID NO: 2878 (sequence of the IR-161 antibody VH)

An example of the VL in the above-mentioned L chain having the amino acid sequence of SEQ ID NO: 2888 (sequence of the IR-161 antibody L-chain CDR1) as CDR1, the amino acid sequence of SEQ ID NO: 2890 (sequence of the IR-161 antibody L-chain CDR2) as CDR2, and the amino acid sequence of SEQ ID NO: 2892 (sequence of the IR-161 antibody L-chain CDR3) as CDR3 of (866) is a VL comprising the amino acid sequence of SEQ ID NO: 2880 (sequence of the IR-161 antibody VL)

The above-mentioned H chains, L chains, VHs, and VLs can be used to prepare the antibodies of the present invention. The present invention also relates to the above-mentioned H chains, L chains, VHs, and VLs.

The above-mentioned antibodies of (1) to (872) include not only monovalent antibodies but also multivalent antibodies with two or more valencies. The multivalent antibodies of the present invention include multivalent antibodies whose antigen binding sites are all the same and multivalent antibodies whose antigen binding sites are partially or completely different.

In a preferred embodiment, the above-mentioned antibody of (871) is an antibody with no modified CDRs. For example, the "antibody that comprises one or more amino acid substitutions, deletions, additions, and/or insertions in the antibody of (1), which has equivalent activity as the antibody of (1)" of the above-mentioned antibody of (871) is preferably "an antibody that has equivalent activity as the antibody of (1), and comprises one or more amino acid substitutions, deletions, additions, and/or insertions in the antibody of (1), and comprises an H chain having the amino acid sequence of SEQ ID NO: 6 as CDR1, the amino acid sequence of SEQ ID NO: 8 as CDR2, and the amino acid sequence of SEQ ID NO: 10 as CDR3". Another preferred antibody of the above-mentioned antibody of (871) can be expressed in a similar manner.

However, the above-mentioned antibody of (871) does not exclude an antibody in which CDR(s) is/are modified. Those skilled in the art can modify a CDR amino acid sequence without losing an equivalent activity. Amino acid mutations without losing an equivalent activity can be predicted, for example, using molecular modeling techniques.

Therefore, for the above-mentioned antibody of (871), an antibody having an equivalent activity as an antibody having an H-chain CDR and/or L-chain CDR of:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody,
is expressed as follows:

an antibody that has equivalent activity as an antibody comprising an H chain having the amino acid sequence of SEQ ID NO: a as CDR1, the amino acid sequence of SEQ ID NO: b as CDR2, and the amino acid sequence of SEQ ID NO: c as CDR3, wherein the "antibody that has equivalent activity" comprises an H chain having:

as CDR1, the amino acid sequence of SEQ ID NO: a, or an amino acid sequence with one or several amino acid substitutions, deletions, additions and/or insertions in the amino acid sequence of SEQ ID NO: a;

as CDR2, the amino acid sequence of SEQ ID NO: b, or an amino acid sequence with one or several amino acid substitutions, deletions, additions and/or insertions in the amino acid sequence of SEQ ID NO: b;

as CDR3, the amino acid sequence of SEQ ID NO: c, or an amino acid sequence with one or several amino acid substitutions, deletions, additions and/or insertions in the amino acid sequence of SEQ ID NO: c;

an antibody that has equivalent activity as an antibody comprising an L chain having the amino acid sequence of SEQ ID NO: d as CDR1, the amino acid sequence of SEQ ID NO: e as CDR2, and the amino acid sequence of SEQ ID NO: f as CDR3, wherein the "antibody that has equivalent activity" comprises an L chain having:

as CDR1, the amino acid sequence of SEQ ID NO: d, or an amino acid sequence with one or several amino acid substitutions, deletions, additions and/or insertions in the amino acid sequence of SEQ ID NO: d;

as CDR2, the amino acid sequence of SEQ ID NO: e, or an amino acid sequence with one or several amino acid substitutions, deletions, additions and/or insertions in the amino acid sequence of SEQ ID NO: e;

as CDR3, the amino acid sequence of SEQ ID NO: f, or an amino acid sequence with one or several amino acid substitutions, deletions, additions and/or insertions in the amino acid sequence of SEQ ID NO: f; or an antibody that has equivalent activity as an antibody comprising an H chain having the amino acid sequence of SEQ ID NO: a as CDR1, the amino acid sequence of SEQ ID NO: b as CDR2, and the amino acid sequence of SEQ ID NO: c as CDR3, and an L chain having the amino acid sequence of SEQ ID NO: d as CDR1, the amino acid sequence of SEQ ID NO: e as CDR2, and the amino acid sequence of SEQ ID NO: f as CDR3, wherein the "antibody that has equivalent activity" comprises:

an H chain having:

as CDR1, the amino acid sequence of SEQ ID NO: a, or an amino acid sequence with one or several amino acid substitutions, deletions, additions and/or insertions in the amino acid sequence of SEQ ID NO: a;

as CDR2, the amino acid sequence of SEQ ID NO: b, or an amino acid sequence with one or several amino acid substitutions, deletions, additions and/or insertions in the amino acid sequence of SEQ ID NO: b;

as CDR3, the amino acid sequence of SEQ ID NO: c, or an amino acid sequence with one or several amino acid substitutions, deletions, additions and/or insertions in the amino acid sequence of SEQ ID NO: c and an L chain having:

as CDR1, the amino acid sequence of SEQ ID NO: d, or an amino acid sequence with one or several amino acid substitutions, deletions, additions and/or insertions in the amino acid sequence of SEQ ID NO: d;

as CDR2, the amino acid sequence of SEQ ID NO: e, or an amino acid sequence with one or several amino acid substitutions, deletions, additions and/or insertions in the amino acid sequence of SEQ ID NO: e;

as CDR3, the amino acid sequence of SEQ ID NO: f, or an amino acid sequence with one or several amino acid substitutions, deletions, additions and/or insertions in the amino acid sequence of SEQ ID NO: f.

The antibody of (871) for each of the above antibodies can be expressed by referring to the amino acid SEQ ID NO of H chain CDR1 for "a" above, the amino acid SEQ ID NO of H chain CDR2 for "b" above, the amino acid SEQ ID NO of H chain CDR3 for "c" above, the amino acid SEQ ID NO of L chain CDR1 for "d" above, the amino acid SEQ ID NO of L chain CDR2 for "e" above, the amino acid SEQ ID NO of L chain CDR3 for "f" above. For example, the antibody of (871) for an antibody having equivalent activity as an antibody that has the H chain CDR and/or L chain CDR of the IR-001 antibody can be expressed as follows:

an antibody that has equivalent activity as an antibody comprising an H chain having the amino acid sequence of SEQ ID NO: 6 as CDR1, the amino acid sequence of SEQ ID NO: 8 as CDR2, and the amino acid sequence of SEQ ID NO: 10 as CDR3, wherein the "antibody that has equivalent activity" comprises an H chain having:

as CDR1, the amino acid sequence of SEQ ID NO: 6, or an amino acid sequence with one or several amino acid substitutions, deletions, additions and/or insertions in the amino acid sequence of SEQ ID NO: 6;

as CDR2, the amino acid sequence of SEQ ID NO: 8, or an amino acid sequence with one or several amino acid substitutions, deletions, additions and/or insertions in the amino acid sequence of SEQ ID NO: 8;

as CDR3, the amino acid sequence of SEQ ID NO: 10, or an amino acid sequence with one or several amino acid substitutions, deletions, additions and/or insertions in the amino acid sequence of SEQ ID NO: 10;

an antibody that has equivalent activity as an antibody comprising an L chain having the amino acid sequence of SEQ ID NO: 12 as CDR1, the amino acid sequence of SEQ ID NO: 14 as CDR2, and the amino acid sequence of SEQ ID NO: 16 as CDR3, wherein the "antibody that has equivalent activity" comprises an L chain having:

as CDR1, the amino acid sequence of SEQ ID NO: 12, or an amino acid sequence with one or several amino acid substitutions, deletions, additions and/or insertions in the amino acid sequence of SEQ ID NO: 12;

as CDR2, the amino acid sequence of SEQ ID NO: 14, or an amino acid sequence with one or several amino acid substitutions, deletions, additions and/or insertions in the amino acid sequence of SEQ ID NO: 14;

as CDR3, the amino acid sequence of SEQ ID NO: 16, or an amino acid sequence with one or several amino acid substitutions, deletions, additions and/or insertions in the amino acid sequence of SEQ ID NO: 16; or an antibody that has equivalent activity as an antibody comprising an H chain having the amino acid sequence of SEQ ID NO: 6 as CDR1, the amino acid sequence of SEQ ID NO: 8 as CDR2, and the amino acid sequence of SEQ ID NO: 10 as CDR3, and an L chain having the amino acid sequence of SEQ ID NO: 12 as CDR1, the amino acid sequence of SEQ ID NO: 14 as CDR2, and the amino acid sequence of SEQ ID NO: 16 as CDR3, wherein the "antibody that has equivalent activity" comprises:

an H chain having:

as CDR1, the amino acid sequence of SEQ ID NO: 6, or an amino acid sequence with one or several amino acid substitutions, deletions, additions and/or insertions in the amino acid sequence of SEQ ID NO: 6;

as CDR2, the amino acid sequence of SEQ ID NO: 8, or an amino acid sequence with one or several amino acid substitutions, deletions, additions and/or insertions in the amino acid sequence of SEQ ID NO: 8;

as CDR3, the amino acid sequence of SEQ ID NO: 10, or an amino acid sequence with one or several amino acid substitutions, deletions, additions and/or insertions in the amino acid sequence of SEQ ID NO: 10 and an L chain having:

as CDR1, the amino acid sequence of SEQ ID NO: 12, or an amino acid sequence with one or several amino acid substitutions, deletions, additions and/or insertions in the amino acid sequence of SEQ ID NO: 12;

as CDR2, the amino acid sequence of SEQ ID NO: 14, or an amino acid sequence with one or several amino acid substitutions, deletions, additions and/or insertions in the amino acid sequence of SEQ ID NO: 14;

as CDR3, the amino acid sequence of SEQ ID NO: 16, or an amino acid sequence with one or several amino acid substitutions, deletions, additions and/or insertions in the amino acid sequence of SEQ ID NO: 16.

Furthermore, as mentioned above, regarding the antibodies in the embodiments mentioned below, the antibody of (871) for each of the antibodies can be expressed by referring to the amino acid SEQ ID NOs of VH, VL, CDR of:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody,
for "a" to "h".

In the above antibodies in which CDRs are modified, "several" means, preferably five amino acids or less, more preferably four amino acids or less, more preferably three amino acids or less, more preferably two amino acids. The number of amino acids substituted, deleted, added, and/or inserted between two amino acid sequences can be identified by aligning the amino acid sequences using sequence analysis programs. The programs for alignment include, for example, FASTA (Lipman D J, Pearson W R (1985) Science 227 (4693):1435-1441; Pearson, W R., Lipman, D J (1988) Proc. Natl. Acad. Sci. USA 85 (8): 2444-2448), BLAST (Altschul et al (1990) J. Mol. Biol. 215:403-410; Altschul et al (1997) Nucleic Acids Res. 25: 3389-402).

It is known to those skilled in the art that, in the binding specificity or affinity of an antibody to an antigen, CDR3 plays a particularly important role. Thus, in the antibodies of (871), the CDR3 sequence is preferably conserved. Therefore, in a preferred embodiment, the antibody of (871) can be expressed as follows:

an antibody that has equivalent activity as an antibody comprising an H chain having the amino acid sequence of SEQ ID NO: a as CDR1, the amino acid sequence of SEQ ID NO: b as CDR2, and the amino acid sequence of SEQ ID NO: c as CDR3, wherein the "antibody that has equivalent activity" comprises an H chain having:

as CDR1, the amino acid sequence of SEQ ID NO: a, or an amino acid sequence with one or several amino acid substitutions, deletions, additions and/or insertions in the amino acid sequence of SEQ ID NO: a;

as CDR2, the amino acid sequence of SEQ ID NO: b, or an amino acid sequence with one or several amino acid substitutions, deletions, additions and/or insertions in the amino acid sequence of SEQ ID NO: b;

as CDR3, the amino acid sequence of SEQ ID NO: c;

an antibody that has equivalent activity as an antibody comprising an L chain having the amino acid sequence of SEQ ID NO: d as CDR1, the amino acid sequence of SEQ ID NO: e as CDR2, and the amino acid sequence of SEQ ID NO: f as CDR3, wherein the "antibody that has equivalent activity" comprises an L chain having:

as CDR1, the amino acid sequence of SEQ ID NO: d, or an amino acid sequence with one or several amino acid substitutions, deletions, additions and/or insertions in the amino acid sequence of SEQ ID NO: d;

as CDR2, the amino acid sequence of SEQ ID NO: e, or an amino acid sequence with one or several amino acid substitutions, deletions, additions and/or insertions in the amino acid sequence of SEQ ID NO: e;

as CDR3, the amino acid sequence of SEQ ID NO: f; or an antibody that has equivalent activity as an antibody comprising an H chain having the amino acid sequence of SEQ ID NO: a as CDR1, the amino acid sequence of SEQ ID NO: b as CDR2, and the amino acid sequence of SEQ ID NO: c as CDR3, and an L chain having the amino acid sequence of SEQ ID NO: d as CDR1, the amino acid sequence of SEQ ID NO: e as CDR2, and the amino acid sequence of SEQ ID NO: f as CDR3, wherein the "antibody that has equivalent activity" comprises:

an H chain having:

as CDR1, the amino acid sequence of SEQ ID NO: a, or an amino acid sequence with one or several amino acid substitutions, deletions, additions and/or insertions in the amino acid sequence of SEQ ID NO: a;

as CDR2, the amino acid sequence of SEQ ID NO: b, or an amino acid sequence with one or several amino acid substitutions, deletions, additions and/or insertions in the amino acid sequence of SEQ ID NO: b;

as CDR3, the amino acid sequence of SEQ ID NO: c
and
an L chain having:

as CDR1, the amino acid sequence of SEQ ID NO: d, or an amino acid sequence with one or several amino acid substitutions, deletions, additions and/or insertions in the amino acid sequence of SEQ ID NO: d;

as CDR2, the amino acid sequence of SEQ ID NO: e, or an amino acid sequence with one or several amino acid substitutions, deletions, additions and/or insertions in the amino acid sequence of SEQ ID NO: e;

as CDR3, the amino acid sequence of SEQ ID NO: f.

Regarding the antibodies of (871), an antibody having equivalent activity as an antibody that has the VH and/or VL of:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody, can be expressed as follows:

an antibody that has equivalent activity as an antibody comprising an H chain having VH comprising the amino acid sequence of SEQ ID NO: g, wherein the "antibody that has equivalent activity" comprises an H chain having VH comprising an amino acid sequence in which one or several amino acids are substituted, deleted, added, and/or inserted in the amino acid sequence of SEQ ID NO: g;

an antibody that has equivalent activity as an antibody comprising an L chain having VL comprising the amino acid sequence of SEQ ID NO: h, wherein the "antibody that has equivalent activity" comprises an H chain having VL comprising an amino acid sequence in which one or several amino acids are substituted, deleted, added, and/or inserted in the amino acid sequence of SEQ ID NO: h;

or an antibody that has equivalent activity as an antibody comprising an H chain having VH comprising the amino acid sequence of SEQ ID NO: g and an L chain having VL comprising the amino acid sequence of SEQ ID NO: h, wherein the "antibody that has equivalent activity" comprises an H chain having VH comprising the amino acid sequence of SEQ ID NO: g, or an amino acid sequence in which one or several amino acids are substituted, deleted, added, and/or inserted in the amino acid sequence of SEQ ID NO: g, and an L chain having VL comprising the amino acid sequence of SEQ ID NO: h, or an amino acid sequence in which one or several amino acids are substituted, deleted, added, and/or inserted in the amino acid sequence of SEQ ID NO: h.

The antibody of (871) for each of the above antibodies can be expressed by referring to the amino acid SEQ ID NO of VH for "g" above, and the amino acid SEQ ID NO of VL for "h" above. For example, the antibody of (871) for an antibody having equivalent activity as an antibody that has the VH and/or VL chain of the IR-001 antibody can be expressed as follows:

an antibody that has equivalent activity as an antibody comprising an H chain having VH comprising the amino acid sequence of SEQ ID NO: 2290, wherein the "antibody that has equivalent activity" comprises an H chain having VH comprising an amino acid sequence in which one or several amino acids are substituted, deleted, added, and/or inserted in the amino acid sequence of SEQ ID NO: 2290;

an antibody that has equivalent activity as an antibody comprising an L chain having VL comprising the amino acid sequence of SEQ ID NO: 2292, wherein the "antibody that has equivalent activity" comprises an H chain having VL comprising an amino acid sequence in which one or several amino acids are substituted, deleted, added, and/or inserted in the amino acid sequence of SEQ ID NO: 2292;

or an antibody that has equivalent activity as an antibody comprising an H chain having VH comprising the amino acid sequence of SEQ ID NO: 2290 and an L chain having VL comprising the amino acid sequence of SEQ ID NO: 2292, wherein the "antibody that has equivalent activity" comprises an H chain having VH comprising the amino acid sequence of SEQ ID NO: 2290, or an amino acid sequence in which one or several amino acids are substituted, deleted, added, and/or inserted in the amino acid sequence of SEQ ID NO: 2290, and an L chain having VL comprising the amino acid sequence of SEQ ID NO: 2292, or an amino acid sequence in which one or several amino acids are substituted, deleted, added, and/or inserted in the amino acid sequence of SEQ ID NO: 2292.

In the above antibodies in which VH and/or VL are modified, "several" means, preferably 50 amino acids or less, 30 amino acids or less, 20 amino acids or less, 15 amino acids or less, or 10 amino acids or less, more preferably nine, eight, seven, six, five, four, three, or two amino acids. As long as the equivalent activity is retained, the positions of the modified amino acids are not particularly limited; however, amino acids in FR are preferably modified.

Thus, in a preferred embodiment, among the antibodies of (871), an antibody having equivalent activity as an antibody that has the VH and/or VL of:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody, can be expressed as follows:

an antibody that has equivalent activity as an antibody comprising an H chain having VH comprising the amino acid sequence of SEQ ID NO: a, wherein the "antibody that has equivalent activity" comprises an H chain having VH comprising an amino acid sequence in which one or several amino acids are substituted, deleted, added, and/or inserted in the amino acid sequence of SEQ ID NO: a, and the amino acid sequence of SEQ ID NO: b as CDR1, the amino acid sequence of SEQ ID NO: c as CDR2, and the amino acid sequence of SEQ ID NO: d as CDR3;

an antibody that has equivalent activity as an antibody comprising an L chain having VL comprising the amino acid sequence of SEQ ID NO: e, wherein the "antibody that has equivalent activity" comprises an L chain having VL comprising an amino acid sequence in which one or several amino acids are substituted, deleted, added, and/or inserted in the amino acid sequence of SEQ ID NO: e, and the amino acid sequence of SEQ ID NO: f as CDR1, the amino acid sequence of SEQ ID NO: g as CDR2, and the amino acid sequence of SEQ ID NO: h as CDR3;

or an antibody that has equivalent activity as an antibody comprising an H chain having VH comprising the amino acid sequence of SEQ ID NO: a and VL comprising the amino acid sequence of SEQ ID NO: e, wherein the "antibody that has equivalent activity" comprises:

an H chain having VH comprising the amino acid sequence of SEQ ID NO: a, or an amino acid sequence in which one or several amino acids are substituted, deleted, added, and/or inserted in the amino acid sequence of SEQ ID NO: a, and the amino acid sequence of SEQ ID NO: b as CDR1, the amino acid sequence of SEQ ID NO: c as CDR2, and the amino acid sequence of SEQ ID NO: d as CDR3,
and
an L chain having VL comprising the amino acid sequence of SEQ ID NO: e, or an amino acid sequence in which one or several amino acids are substituted, deleted, added, and/or inserted in the amino acid sequence of SEQ ID NO: e, and the amino acid sequence of SEQ ID NO: f as CDR1, the amino acid sequence of SEQ ID NO: g as CDR2, and the amino acid sequence of SEQ ID NO: h as CDR3.

The antibody of (871) for each of the above antibodies can be expressed by referring to the amino acid SEQ ID NO of VH for "a" above, the amino acid SEQ ID NO of H chain CDR1 for "b" above, the amino acid SEQ ID NO of H chain CDR2 for "c" above, the amino acid SEQ ID NO of H chain CDR3 for "d" above, the amino acid SEQ ID NO of VL for "e" above, the amino acid SEQ ID NO of L chain CDR1 for "f" above, the amino acid SEQ ID NO of L chain CDR2 for "g" above, the amino acid SEQ ID NO of L chain CDR3 for "h" above. For example, the antibody of (871) for an antibody having equivalent activity as an antibody that has the VH and/or VL of the IR-001 antibody can be expressed as follows:

an antibody that has equivalent activity as an antibody comprising an H chain having VH comprising the amino acid sequence of SEQ ID NO: 2290, wherein the "antibody that has equivalent activity" comprises an H chain having VH comprising an amino acid sequence in which one or several amino acids are substituted, deleted, added, and/or inserted in the amino acid sequence of SEQ ID NO: 2290, and the amino acid sequence of SEQ ID NO: 6 as CDR1, the amino acid sequence of SEQ ID NO: 8 as CDR2, and the amino acid sequence of SEQ ID NO: 10 as CDR3;

an antibody that has equivalent activity as an antibody comprising an L chain having VL comprising the amino acid sequence of SEQ ID NO: 2292, wherein the "antibody that has equivalent activity" comprises an L chain having VL comprising an amino acid sequence in which one or several amino acids are substituted, deleted, added, and/or inserted in the amino acid sequence of SEQ ID NO: 2292, and the amino acid sequence of SEQ ID NO: 12 as CDR1, the amino acid sequence of SEQ ID NO: 14 as CDR2, and the amino acid sequence of SEQ ID NO: 16 as CDR3;
or
an antibody that has equivalent activity as an antibody comprising an H chain having VH comprising the amino acid sequence of SEQ ID NO: 2290 and VL comprising the amino acid sequence of SEQ ID NO: 2292, wherein the "antibody that has equivalent activity" comprises:

an H chain having VH comprising the amino acid sequence of SEQ ID NO: 2290, or an amino acid sequence in which one or several amino acids are substituted, deleted, added, and/or inserted in the amino acid sequence of SEQ ID NO: 2290, and the amino acid sequence of SEQ ID NO: 6 as CDR1, the amino acid sequence of SEQ ID NO: 8 as CDR2, and the amino acid sequence of SEQ ID NO: 10 as CDR3,
and
an L chain having VL comprising the amino acid sequence of SEQ ID NO: 2292, or an amino acid sequence in which one or several amino acids are substituted, deleted, added, and/or inserted in the amino acid sequence of SEQ ID NO: 2292, and the amino acid sequence of SEQ ID NO: 12 as CDR1, the amino acid sequence of SEQ ID NO: 14 as CDR2, and the amino acid sequence of SEQ ID NO: 16 as CDR3.

In the modified antibodies that have the H chain CDR and/or L chain CDR, or VH and/or VL of:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody, the amino acid modifications are preferably conserved amino acid substitutions, as described below in detail. Thus, in a more preferred embodiment, in the antibodies of (871) described above, "conservative amino acid substitution" can be performed, instead of "substitution, deletion, addition, and/or insertion".

Methods for preparing a polypeptide having activity equivalent to that of a certain polypeptide that are well known to those skilled in the art include methods for introducing mutations into a polypeptide. For example, one skilled in the art can prepare an antibody having activity equivalent to that of an antibody of the present invention by introducing appropriate mutations into the antibody using site-directed mutagenesis (Hashimoto-Gotoh, T. et al. (1995) Gene 152, 271-275; Zoller, M J, and Smith, M. (1983) Methods Enzymol. 100, 468-500; Kramer, W. et al. (1984) Nucleic Acids Res. 12, 9441-9456; Kramer W, and Fritz H J (1987) Methods. Enzymol. 154, 350-367; Kunkel, T A (1985) Proc. Natl. Acad. Sci. USA. 82, 488-492; Kunkel (1988) Methods Enzymol. 85, 2763-2766) and such. Amino acid mutations may also occur naturally. The antibodies of the present invention also include an antibody that comprises an amino acid sequence with one or more amino acid mutations in the amino acid sequence of an antibody of the present invention, and which has activity equivalent to that of the antibody of the present invention.

Amino acid residues are preferably mutated into other amino acids that conserve the properties of the amino acid side chains. For example, amino acids are categorized as follows depending on the side chain properties: hydrophobic amino acids (A, I, L, M, F, P, W, Y, and V), hydrophilic amino acids (R, D, N, C, E, Q, G, H, K, S, and T), amino acids with aliphatic side chains (G, A, V, L, I, and P), amino acids with hydroxyl-containing side chains (S, T, and Y), amino acids with sulfur atom-containing side chains (C and M), amino acids with carboxylic acid- and amide-containing side chains (D, N, E, and Q), amino acids with basic side chains (R, K, and H), and amino acids with aromatic ring-containing side chains (H, F, Y, and W) (amino acids are represented by one-letter codes in parentheses). "Conservative amino acid substitution" refers to substitution of an amino acid with another amino acid with a conserved amino acid side chain characteristics. In the antibodies of (871), amino acid sequence mutations in an antibody are preferably "conservative amino acid substitutions".

Generally, a polypeptide having an amino acid sequence, in which one or more amino acid residues are modified (deleted, added, and/or substituted with other amino acids) in a certain amino acid sequence, is known to retain its original biological activity (function).

In addition to the above-mentioned modifications, the antibodies of the present invention may be conjugated to other substances as long as the activity is maintained. Examples of the substances include peptides, lipids, sugars and sugar chains, acetyl groups, and natural and synthetic polymers. These modifications may be performed to confer additional functions to the antibodies, or to stabilize the antibodies.

Antibodies in which several amino acid residues have been added to the amino acid sequence of an antibody of the present invention include fusion proteins containing the antibody. In the fusion proteins, the antibody is fused with another peptide or protein. Methods for producing a fusion protein can be carried out by ligating a polynucleotide encoding an antibody of the present invention in frame with a polynucleotide encoding another peptide or polypeptide, and inserting this into an expression vector, and expressing the fusion construct in a host. Techniques known to those skilled in the art can be used for this purpose. The peptides or polypeptides fused with an antibody of the present invention include, for example, known peptides such as FLAG (Hopp, T. P. et al., BioTechnology (1988) 6, 1204-1210), 6×His consisting of six histidine (His) residues, 10×His, Influenza hemagglutinin (HA), human c-myc fragments, VSV-GP fragments, p18HIV fragments, T7-tag, HSV-tag, E-tag, SV40T antigen fragments, lck tag, alpha-tubulin fragments, B-tag, and Protein C fragments; glutathione-S-transferase (GST); immunoglobulin constant regions; beta-galactosidase; and maltose-binding protein (MBP), etc. Commercially available polynucleotides encoding these peptides or polypeptides can be fused with polynucleotides encoding the antibodies of the present invention, and the fusion polypeptides can be produced by expressing the fusion polynucleotides thus prepared.

The antibodies of the present invention may differ in the amino acid sequence, molecular weight, presence or absence of sugar chains, structure and such, depending on the cell or host producing the antibodies or the purification method. However, as long as the obtained antibody has an activity equivalent to an antibody of the present invention, it is included in the present invention.

Herein, "equivalent activity" means that the antibody of interest has the same biological or biochemical activity as an antibody of the present invention. The "activity" of the present invention includes, for example, activity to specifically bind to A beta oligomers but not bind to A beta monomers, activity to specifically bind to A beta oligomers but not bind to A beta monomers and amyloid precursor protein, anti-neurotoxic activity, A beta amyloid fibril formation suppressing activity, anti-synaptic toxicity activity, anti-memory impairment activity, anti-A beta deposition activity, anti-thioflavin S-positive plaque formation activity, and anti-A beta oligomer acccumulation activity.

In a preferred embodiment, the "activity" of the present invention is activity to specifically bind to A beta oligomers but not bind to A beta monomers. As shown in the Example, the "activity to specifically bind to A beta oligomers but not bind to A beta monomer" is preferably assessed by dot blot or competitive ELISA. Specific methods of dot blot or competitive ELISA include methods described in the Examples. Furthermore, the binding activity towards A beta oligomers and monomers can be assessed by other immunodetection methods, for example, absorbance measurement, enzyme-linked immunosorbent assay (ELISA), enzyme immunoassay (EIA), radioimmunoassay (RIA), immunofluorescent method, etc. For example, in ELISA, an antibody is immobilized onto a plate, an antigen for the antibody is added to the plate, and a culture supernatant of antibody-producing cells or a purified antibody is added. Then, a secondary antibody that recognizes a primary antibody and that is tagged with an enzyme such as alkali phosphatase is added, and the plate is incubated. After washing, an enzyme substrate such as p-nitrophenyl phosphate is added to the plate, and the absorbance is measured to assess the antigen-binding ability of a sample of interest. The binding abilities for A beta oligomers and monomers are preferably measured by the same method; however, they can be measured by different methods. For example, the binding to A beta oligomers can be analysed using Biacore (GE Healthcare Sciences).

When the "activity" of the present invention is the activity to specifically bind to A beta oligomers but not bind to A beta monomers and amyloid precursor protein, the activity can be assessed by the above-mentioned methods or methods described in the Examples.

When the "activity" of the present invention is anti-neurotoxic activity, this activity can be assessed by, for example, culturing neurons with A beta in the presence or absence of an antibody, and measuring the A beta-induced cytotoxicity level inhibited by the antibody. A beta-induced cytotoxicity can be measured by, for example, live/dead two color fluorescent assay, measurement of the LDH amount derived from dead cells released into a medium. For the measurement of the LDH amount, for example, CytoTox96 (Promega) or such can be used. Specific methods for measuring anti-neurotixic activity include the methods described in the Examples.

When the "activity" of the present invention is A beta amyloid fibril formation suppressing activity, this activity can be assessed, for example, by incubating an A beta solution with or without an antibody, and detecting the A beta amyloid fibril formation level suppressed by the antibody. The amount of A beta amyloid fibril is assessed, for example, by adding a ThT (Thioflavin T) solution to a culture, and the amount of ThT bound to amyloid fibrils with ThT fluoresence. Specific methods for measuring A beta amyloid fibril formation suppressing activity include the methods described in the Examples.

When the "activity" of the present invention is anti-synaptic toxicity activity, this activity can be assessed, for example, by detecting synaptic toxicity suppressing effect by antibody administration to mutant human APP gene-expressing mice (for example, Tg2576 mice, Taconics, USA). The assessment of synaptic toxicity can be performed by mouse memory impairment test, analysis of the number of swollen dystrophic neurites using an anti-synaptophysin antibody, immunofluorescent analysis of mouse brain sections using anti-synaptophysin or anti-drebrin antibodies. When the "activity" of the present invention is anti-memory impairment activity, this activity is assessed by memory impairment test using mutant APP gene-expressing mice. If the "activity" of the present invention is anti-A beta deposition activity, anti-thioflavin S-positive plaque formation activity, or anti-A beta oligomer accumulation activity, these activities can be assessed by antibody administration test using mutant APP gene-expressing mice.

Specific methods for measuring the anti-memory impairment activity, anti-synaptic toxicity activity, anti-A beta deposition activity, anti-thioflavin S-positive plaque formation activity, and anti-A beta oligomer accumulation activity include the following method.

Female non-transgenic (non-Tg) mice for control, and Tg2576 mice having and overexpressing the Swedish-type mutant human APP gene with dual mutations (K670N and M671L) derived from familial AD are administered with the antibody of the present invention (dosage within the range of 0.4 to 5.0 mg/kg/w) or PBS into the caudal vein. The mouse age at the initiation of administration is six months or later at which memory and learning impairments are expressed, for monitoring therapeutic effect; or four months for monitoring prophylactic effect. Antibody administration period is two months for monitoring therapeutic effect, and nine months for monitoring prophylactic effect. To measure the anti-memory impairment activity, the following three behavioral paradigms are analysed after the antibody administration period (Mouri A, FASEB J, 21: 2135-2148, 2007): (1) Y-maze test for short-term memory; (2) novel object recognition test; (3) contextual fear conditioning test. To assess the other activities, mice are sacrificed after the behavioral analysis, and the brain hemispheres are sliced into 10 to 30-micro m-thick sagittal sections using a cryotome (RM 2145; Leica, Wetzlar, Germany). To observe thioflavin S-positive plaque formation, thioflavin S staining is performed as described in Wyss-Coray et al., 2001. The formation of swollen dystrophic neurites is observed using an anti-synaptophysin antibody (Chemicon, Temecula, Calif.). For each mouse, the number of thioflavin S-positive plaques and synaptophysin-positive swollen dystrophic neurites are calculated in four or five sections from a brain hemisphere at 40-fold magnification. To observe A beta deposition, serial sections briefly pre-treated with formic acid or Protease K are stained using an A beta immunostaining kit (Sigma, St. Louis, Mo.) or anti-A beta polyclonal antibody (Biosource), and immuno-positive signals are visualized using an ABC elite kit (Vector Laboratories). Images of the cerebral cortex and hippocampus are recorded using a digital camera connected with a microscope, and analyzed using a simple PCI software (Compix Imaging System, Lake Oswego, Oreg.). The number of thioflavin S-positive plaques and synaptophysin-positive swollen dystrophic neurites was determined in a double blind manner. Synaptic degeneration is observed by immunostaining using anti-synaptophysin or anti-drebrin antibodies. To assess the anti-A beta oligomer deposition activity, brain homogenates are prepared from the other brain hemisphere of the same mouse using the method by Kawarabayashi et al., J. Neuroscience 2001), and the amount of A beta oligomers is measured by SDS-PAGE and immunoblot analysis. For detection antibodies, commercially available anti-A beta oligomer monoclonal antibodies (e.g., 6E10, Covance Immuno-Technologies, Dedham, Mass.) or polyclonal antibodies (e.g., A11, Biosource, Carmarillo, Calif.) can be used.

The term "equivalent" in "equivalent activity" means that a value obtained as a biological or biochemical activity differs within 20% between two antibodies compared. The difference of the activity value is, preferably within 15%, within 10%, within 5%, or within 2.5%.

Antibodies that bind to an epitope to which an antibody of any one of (1) to (870) above binds can be obtained by methods known to those skilled in the art. For example, the antibodies can be obtained by (i) determining the epitope bound by the antibody of any one of (1) to (870) using a conventional method, and producing the antibodies using a polypeptide comprising an amino acid sequence included in the epitope as an immunogen; or (ii) determining the epitopes of antibodies produced by a conventional method, and selecting antibodies whose epitope is the same as that of the antibody of any one of (1) to (870).

The above-mentioned antibodies of (1) to (870) also include any type of antibodies such as the above-described minibodies, antibodies with modified amino acid sequences such as humanized antibodies and chimeric antibodies, non-human animal antibodies, human antibodies, modified antibodies conjugated to other molecules (for example, polymers such as polyethylene glycol), and sugar chain-modified antibodies.

In a preferred embodiment, the antibodies of the present invention include:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies. These antibodies can be obtained by the method described in the Examples. Alternatively, the antibodies can be prepared based on their sequence information.

In a preferred embodiment, the antibodies of the present invention include modified antibodies such as chimeric antibodies or humanized antibodies. In a more preferred embodiment, the chimeric antibodies include antibodies comprise a variable region derived from:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody;

and a constant region derived from human immunoglobulin. In a more preferred embodiment, humanized antibodies include antibodies comprise CDR derived from:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, or IR-161 antibody; and FR derived from human immunoglobulin, and a constant region derived from human immunoglobulin.

The above chimeric antibodies can be expressed as follows:

an antibody that comprises an H chain having VH comprising the amino acid sequence of SEQ ID NO: a, and CH of a human antibody;

an antibody that comprises an L chain having VL comprising the amino acid sequence of SEQ ID NO: b, and CL of a human antibody; or an antibody that comprises an H chain having VH comprising the amino acid sequence of SEQ ID NO: a, and CH of a human antibody, and an L chain having VL comprising the amino acid sequence of SEQ ID NO: b, and CL of a human antibody.

Preferred embodiments of chimeric antibodies from each of the above antibodies can be expressed by referring to the amino acid SEQ ID NO of VH for "a" above, and the amino acid SEQ ID NO of VL for "b" above. For example, chimeric antibodies for the IR-001 antibody can be expressed as follows:

an antibody that comprises an H chain having VH comprising the amino acid sequence of SEQ ID NO: 2290, and CH of a human antibody;

an antibody that comprises an L chain having VL comprising the amino acid sequence of SEQ ID NO: 2292, and CL of a human antibody; or an antibody that comprises an H chain having VH comprising the amino acid sequence of SEQ ID NO: 2290, and CH of a human antibody, and an L chain having VL comprising the amino acid sequence of SEQ ID NO: 2292, and CL of a human antibody.

The above humanized antibodies can be expressed as follows:

an antibody that comprises an H chain having CDR of VH comprising the amino acid sequence of SEQ ID NO: a, FR of VH of a human antibody, and CH of a human antibody;

an antibody that comprises an L chain having CDR of VL comprising the amino acid sequence of SEQ ID NO: b, FR of VL of a human antibody, and CL of a human antibody; or an antibody that comprises an H chain having CDR of VH comprising the amino acid sequence of SEQ ID NO: a, FR of VH of a human antibody, and CH of a human antibody, and an L chain having CDR of VL comprising the amino acid sequence of SEQ ID NO: b, FR of VL of a human antibody, and CL of a human antibody.

Preferred embodiments of humanized antibodies from each of the above antibodies can be expressed by referring to the amino acid SEQ ID NO of VH for "a" above, and the amino acid SEQ ID NO of VL for "b" above. For example, humanized antibodies for the IR-001 antibody can be expressed as follows:

an antibody that comprises an H chain having CDR of VH comprising the amino acid sequence of SEQ ID NO: 2290, FR of VH of a human antibody, and CH of a human antibody;

an antibody that comprises an L chain having CDR of VL comprising the amino acid sequence of SEQ ID NO: 2292, FR of VL of a human antibody, and CL of a human antibody; or an antibody that comprises an H chain having CDR of VH comprising the amino acid sequence of SEQ ID NO: 2290, FR of VH of a human antibody, and CH of a human antibody, and an L chain having CDR of VL comprising the amino acid sequence of SEQ ID NO: 2292, FR of VL of a human antibody, and CL of a human antibody.

The above modified antibodies can be produced using known methods.

Since the antigenicity of a chimeric antibody or a humanized antibody in the human body is reduced, such an antibody is useful for administration to humans for therapeutic purposes or such.

Chimeric antibodies are produced by combining sequences derived from different animals. Examples of chimeric antibodies include antibodies comprising the heavy-chain and light-chain variable regions of a mouse antibody and the heavy-chain and light-chain constant regions of a human antibody. The production of chimeric antibodies can be carried out using known methods (see, for example, Jones et al., Nature 321:522-5, 1986; Riechmann et al., Nature 332:323-7, 1988; and Presta, Curr. Opin. Struct. Biol. 2:593-6, 1992). For example, first, genes encoding the variable regions or CDRs of the antibody of interest are prepared from the RNAs of antibody-producing cells by polymerase chain reaction (PCR) or such (see, for example, Larrick et al., "Methods: a Companion to Methods in Enzymology", Vol. 2: 106, 1991; Courtenay-Luck, "Genetic Manipulation of Monoclonal Antibodies" in Monoclonal Antibodies: Production, Engineering and Clinical Application; Ritter et al. (eds.), page 166, Cambridge University Press, 1995, and Ward et al., "Genetic Manipulation and Expression of Antibodies" in Monoclonal Antibodies: Principles and Applications; and Birch et al. (eds.), page 137, Wiley-Liss, Inc., 1995). To prepare chimeric antibodies from any one of the AL-201 to AL-333 antibodies, a gene encoding a variable region or CDR can be synthesized based on the sequence information of each of the antibodies disclosed herein. The prepared genes encoding the variable regions or CDRs are linked to genes encoding the constant regions (e.g., human antibody constant regions) or framework regions (e.g., human antibody framework regions). The genes encoding the constant regions or framework regions may be determined in a manner similar to that for the variable region-encoding or CDR-encoding genes, or alternatively, they can be prepared based on the sequence information of known antibodies. DNA sequences encoding chimeric products and CDR-grafted products may be synthesized completely or partially using oligonucleotide synthesis techniques. For example, the oligonucleotide synthesis described by Jones et al. (Nature 321:522-5, 1986) may be performed. Furthermore, in some cases, site-directed mutagenesis and polymerase chain reaction techniques may be appropriately used. Techniques for oligonucleotide-specific mutagenesis of known variable regions described by Verhoeyen et al. (Science 239: 1534-6, 1988) and Riechmann et al. (Nature 332: 323-7, 1988) may be used for modifying the variable region sequences, for example, to enhance the binding ability of chimeric antibodies. Furthermore, if necessary, enzymatic fill-in of gapped oligonucleotides using T4 DNA polymerase may be performed, for example, as described by Queen et al. (Proc. Natl. Acad. Sci. USA 86: 10029-33, 1989; and WO 90/07861).

For example, CDR-grafting techniques are known in the art ("Immunoglobulin genes", Academic Press (London), pp 260-74, 1989; and Michael A et al., Proc. Natl. Acad. Sci. USA 91: 969-73, 1994). Using the techniques, the CDRs of a certain antibody are replaced with the CDRs of another antibody. Through such replacement, the binding specificity of the former antibody is changed to that of the latter antibody. Among such chimeric antibodies, those in which the framework amino acids are derived from a human antibody are called "humanized antibodies (CDR-grafted antibodies)". When using antibodies to treat humans, human antibodies or humanized antibodies are preferably utilized.

Generally, chimeric antibodies comprise the variable regions of a non-human mammal-derived antibody and the constant regions derived from a human antibody. On the other hand, humanized antibodies comprise the complementarity-determining regions (CDR) of a non-human mammal-derived antibody and the framework regions and constant regions derived from a human antibody.

After producing the chimeric antibodies or humanized antibodies, amino acids in the variable regions (for example, FRs) or the constant regions may be substituted with other amino acids.

The origin of the variable regions of the chimeric antibodies or the CDRs of the humanized antibodies is not particularly limited.

Human antibody-derived C-regions are used for the C-regions of the chimeric antibodies and humanized antibodies. For example, C gamma1, C gamma2, C gamma3, C gamma4, C mu, C delta, C alpha1, C alpha2, and C epsilon can be used for the H-chain C-regions, and C kappa and C lambda can be used for the L-chain C-regions. Their sequences are known. Furthermore, the human antibody C regions can be modified to improve the stability of the antibodies or their production.

The present invention provides polynucleotides encoding the above antibodies of the present invention or antigen-binding fragments thereof.

The polynucleotides of the present invention are not particularly limited as long as they encode the antibodies of the present invention, and may be a DNA or RNA. Furthermore, they may include a non-natural base. The polynucleotides of the present invention can be used for producing the antibodies of the present invention by genetic engineering techniques.

The polynucleotides of the present invention can be obtained by isolating mRNA from antibody-producing cells that produce an antibody of the present invention, obtaining cDNA by reverse transcription reaction, and amplifying the obtained cDNA by PCR or such, as described in the Examples.

In a preferred embodiment, the polynucleotides of the present invention include a polynucleotide encoding an antibody comprising the H chain CDR and/or L chain CDR of each of the following antibodies, or antigen-binding fragments thereof:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies.

In another embodiment, the polynucleotides of the present invention include a polynucleotide encoding an antibody comprising the VH and/or VL of each of the following antibodies, or antigen-binding fragments thereof:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies.

In the above embodiments, the polynucleotides can be obtained by synthesizing the polynucleotides based on the amino acid sequence information of each of the above antibodies described herein.

Furthermore, the present invention provides vectors comprising the polynucleotides of the present invention. The vectors of the present invention are preferably expression vectors for expressing an antibody of the present invention in a host cell. The vectors of the present invention may be used for producing the antibodies of the present invention.

The vectors of the present invention preferably comprise a promoter sequence that enables expression in a host cell, in addition to a polypeptide of the present invention. Furthermore, they may comprise a signal sequence for secretion of an antibody of the present invention. Furthermore, they may comprise a marker gene for selection of a host cell into which a vector of the present invention has been introduced. The components comprised in the vectors are not limited thereto, and may be a suitable component appropriately selected by those skilled in the art.

For example, expression vectors for expression in *E. coli* include vectors that have "ori" for amplification in *E. coli*, and have a promoter such as lacZ promoter (Ward et al., Nature (1989) 341, 544-546; FASEB J. (1992) 6, 2422-2427), araB promoter (Better et al., Science (1988) 240, 1041-1043), or T7 promoter, and a marker gene such as a drug-resistance gene against ampicillin, tetracycline, kanamycin, chloramphenicol, etc. The vectors include M13 vectors, pUC vectors, pBR322, pBluescript, pCR-Script, etc. Furthermore, for a signal sequence, the pelB signal sequence (Lei, S. P. et al J. Bacteriol. (1987) 169, 4379) or such can be used.

The vectors of the present invention other than *E. coli* expression vectors include, for example, mammal-derived expression vectors (e.g., pcDNA3 (Invitrogen), pEGF-BOS (Nucleic Acids. Res. 1990, 18(17), p 5322), pEF, pCDM8), insect cell-derived expression vectors (e.g, Bac-to-BAC baculovirus expression system (Gibco BRL), pBacPAK8), plant-derived expression vectors (e.g., pMH1, pMH2), animal virus-derived expression vectors (e.g., pHSV, pMV, pAdexLcw), retrovirus-derived expression vectors (e.g., pZIPneo), yeast-derived expression vectors (e.g., *Pichia* Expression Kit (Invitrogen)), pNV11, SP-Q01), and *Bacillus*-derived expression vectors (e.g., pPL608, pKTH50).

Expression vectors for expression in animal cells such as CHO cells, COS cells, NIH3T3 cells include vectors that have a promoter such as SV40 promoter (Mulligan et al., Nature (1979) 277, 108), MMTV-LTR promoter, EF1 alpha promoter (Mizushima et al., Nucleic Acids Res. (1990) 18, 5322), CMV promoter, or such; and a marker gene such as s drug-resistance gene against neomycin, G418, etc. These vectors include, for example, pMAM, pDR2, pBK-RSV, pBK-CMV, pOPRSV, pOP13, etc. As a signal sequence, any one of those described in the Examples can be used.

Furthermore, the present invention provides host cells that produce an antibody of the present invention or antigen-binding fragment thereof. The host cells include cells that have a polynucleotide of the present invention or a vector of the present invention. The host cells of the present invention may be used to produce the antibodies or antigen-binding fragments of the present invention.

The host cells of the present invention are not limited to hybridomas that produce an antibody of the present invention, and may be prokaryotes or eukaryotes into which a vector of the present invention has been introduced. When eukaryotes are used as host cells, for example, animal cells, plant cells, or fungal cells can be used. Animal cells include mammal cells (CHO (J. Exp. Med. (1995) 108, 945), COS, 3T3, myeloma, BHK (baby hamster kidney), HeLa, Vero cells, etc.), amphibian cells (Xenopus oocytes (Valle, et al., Nature (1981) 291, 358-340), etc.), insect cells (Sf9, Sf21, Tn5, etc.). As plant cells, for example, cells derived from *Nicotiana tabacum* are known as a protein expression system, and they may be cultured into callus and used. Fungal cells include, for example, yeast (e.g., the genus *Saccharomyces* (*Saccharomyces cerevisiae, Saccharomyces* pombe, etc.), filamentous fungi (e.g., the genus *Aspergillus* (*Aspergillus niger*, etc.). Prokaryotic cells include, for example, *E. coli* and *Bacillus*. Vectors can be introduced into host cell by calcium phosphate methods, DEAE dextran methods, methods using cationic liposome DOTAP (Boehringer Manheim), electroporation methods, lipofection methods, etc.

Furthermore, the present invention provides antibodies produced from the above host cells.

Furthermore, the present invention provides compositions comprising the above-mentioned antibody of the present invention and a pharmaceutically acceptable carrier.

As described below, the present invention strongly suggests that each of the following antibodies are promising candidates for therapeutic antibodies for preventing Alzheimer-like phenotypes:

the IR-001, IR-002, IR-004, IR-005, IR-006, IR-007, IR-008, IR-011, IR-012, IR-013, IR-014, IR-015, IR-017, IR-020, IR-021, IR-022, IR-023, IR-024, IR-025, IR-026, IR-027, IR-028, IR-029, IR-030, IR-031, IR-032, IR-033, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-088, IR-089, IR-090, IR-092, IR-093, IR-094, IR-095, IR-097, IR-098, IR-100, IR-101, IR-102, IR-104, IR-105, IR-106, IR-107, IR-108, IR-109, IR-110, IR-112, IR-114, IR-115, IR-116, IR-117, IR-118, IR-119, IR-120, IR-121, IR-122, IR-123, IR-124, IR-125, IR-126, IR-127, IR-128, IR-129, IR-131, IR-132, IR-133, IR-134, IR-135, IR-136, IR-137, IR-138, IR-139, IR-140, IR-141, IR-142, IR-143, IR-144, IR-145, IR-146, IR-147, IR-149, IR-150, IR-151, IR-152, IR-153, IR-154, IR-155, IR-156, IR-157, IR-158, IR-159, IR-160, and IR-161 antibodies. Memory deterioration has been shown to be related to synaptic dysfunction caused by soluble A beta oligomers (Klein W L, 2001, Trends Neurosci; and Selkoe D J, 2002, Science). Excessive accumulation and deposition of A beta oligomers may trigger the complicated downstream cascades that cause Alzheimer's disease. Thus, therapeutic intervention using a composition comprising an antibody or antigen-binding fragment of the present invention and a pharmaceutically acceptable carrier could be effective for blocking the pathologic cascades, and thus this could enable the treatment of Alzheimer's disease (WO2009/051220, WO2009/099176, U.S. Ser. No. 12/533,294, and U.S. Ser. No. 12/533,348).

The "treatment" or "prevention" of the present invention does not necessarily have complete therapeutic or preventive effects against organs or tissues exhibiting symptoms of disorders or diseases, but may have partial effects or effects of suppressing the progression of symptoms.

"Treatment of Alzheimer's disease" in the present invention means amelioration or suppression of the progression of a symptom of at least one symptom that may be caused by Alzheimer's disease, and examples include amelioration or suppression of cognitive impairment, amelioration or suppression of senile plaque formation, amelioration or suppression of synaptic dysfunction, and reduction or suppression of A beta accumulation in brain tissues, blood, or such. Herein, "cognitive impairment" includes, for example, memory impairment including long term/short term memory impairment, object recognition memory impairment, spatial memory impairment, and associative and emotional memory impairment. Herein, "prevention of Alzheimer's disease" means suppression of at least one symptom that may be caused by Alzheimer's disease, and includes suppression of development of cognitive impairment, suppression of senile plaque formation, suppression of development of synaptic dysfunction, suppression of A beta accumulation in brain tissues, blood, or such.

The present invention provides pharmaceutical compositions or pharmaceutical agents which comprise as an active ingredient a composition comprising the above-described antibody or antigen-binding fragment of the present invention and a pharmaceutically acceptable carrier. The above pharmaceutical compositions or pharmaceutical agents are expressed as "pharmaceutical compositions or pharmaceutical agents comprising the above-described antibody or antigen-binding fragment of the present invention as an active ingredient, and a pharmaceutically acceptable carrier".

In the present invention, the phrase "comprising as an active ingredient a composition comprising the above-described antibody or antigen-binding fragment of the present invention and a pharmaceutically acceptable carrier", or "comprising the above-described antibody or antigen-binding fragment as an active ingredient" mean comprising a composition comprising the above-described antibody or antigen-binding fragment of the present invention and a pharmaceutically acceptable carrier, or the above-described antibody or antigen-binding fragment of the present invention as a major ingredient or a component that shows physiological activity or pharmacological function, but does not limit its content rate.

Examples of the above-mentioned pharmaceutical compositions include agents against cognitive impairment, Alzheimer's disease therapeutic agents, agents for suppressing the progression of Alzheimer's disease, agents for suppressing senile plaque formation, agents for suppressing A beta accumulation, anti-neurotoxic agents (agents for neutralizing neurotoxicity), agents for inhibiting A beta amyloid fibril formation, and anti-synaptic toxicity agents (agents for neutralizing synaptic toxicity).

The above-mentioned pharmaceutical composition of the present invention can be expressed, for example, as "methods for suppressing Alzheimer's disease" which comprise the step of administering to a subject (individual) a composition comprising the above-described antibody or antigen-binding fragment of the present invention and a pharmaceutically acceptable carrier. Alternatively, it can be expressed, for example, as "methods for suppressing Alzheimer's disease" which comprise the step of administering to a subject a therapeutically effective amount of the above-described antibody or antigen-binding fragment of the present invention. In other embodiments, examples include methods for suppressing cognitive impairment, methods for suppressing the progression of Alzheimer's disease, methods for suppressing senile plaque formation, methods for suppressing A beta accumulation, methods for neutralizing (suppressing) neurotoxic activity, methods for inhibiting A beta amyloid fibril formation, and methods for neutralizing (suppressing) synaptic toxicity. In further embodiments, examples include methods for preventing and/or treating cognitive impairment, and methods for preventing and/or treating Alzheimer's disease.

The present invention also provides use of a composition comprising the above-described antibody or antigen-binding fragment of the present invention and a pharmaceutically acceptable carrier for the manufacture of the above-mentioned pharmaceutical composition. The present invention further provides use of the above-described antibody or antigen-binding fragment of the present invention for the manufacture of the above-described pharmaceutical composition.

Furthermore, the present invention relates to the following antibodies or antigen-binding fragments.

The above-described antibody or antigen-binding fragment of the present invention for use in preventing and/or treating cognitive impairment.

The above-described antibody or antigen-binding fragment of the present invention for use in preventing and/or treating Alzheimer's disease.

The above-described antibody or antigen-binding fragment of the present invention for use in suppressing the progression of Alzheimer's disease.

The above-described antibody or antigen-binding fragment of the present invention for use in suppressing senile plaque formation.

The above-described antibody or antigen-binding fragment of the present invention for use in suppressing A beta accumulation.

The above-described antibody or antigen-binding fragment of the present invention for use in neutralizing (suppressing) neurotoxic activity.

The above-described antibody or antigen-binding fragment of the present invention for use in inhibiting A beta amyloid fibril formation.

The above-described antibody or antigen-binding fragment of the present invention for use in neutralizing (suppressing) synaptic toxicity.

The present invention also relates to the following:

Use of the above-described antibody or antigen-binding fragment of the present invention for preventing and/or treating cognitive impairment.

Use of the above-described antibody or antigen-binding fragment of the present invention for preventing and/or treating Alzheimer's disease.

Use of the above-described antibody or antigen-binding fragment of the present invention for suppressing the progression of Alzheimer's disease.

Use of the above-described antibody or antigen-binding fragment of the present invention for suppressing senile plaque formation.

Use of the above-described antibody or antigen-binding fragment of the present invention for use in suppressing A beta accumulation.

Use of the above-described antibody or antigen-binding fragment of the present invention for neutralizing (suppressing) neurotoxicity.

Use of the above-described antibody or antigen-binding fragment of the present invention for inhibiting A beta amyloid fibril formation.

Use of the above-described antibody or antigen-binding fragment of the present invention for neutralizing (suppressing) synaptic toxicity.

The above-mentioned pharmaceutical compositions or agents of the present invention can be administered to humans or other animals. In the present invention, non-human animals to which the pharmaceutical compositions or agents are administered include mice, rats, guinea pigs, rabbits, chickens, cats, dogs, sheep, pigs, cattle, monkeys, baboons, and chimpanzees. These animals preferably exhibit at least one symptom selected from, for example, cognitive impairment, senile plaque formation, synaptic dysfunction, A beta accumulation in brain tissues or blood, etc.

Antibodies or antigen-binding fragments contained in the pharmaceutical compositions of the present invention are not particularly limited as long as they are included in the above-mentioned antibodies or antigen-binding fragments of the present invention, and examples include the antibodies or antigen-binding fragments described herein.

When using the above-mentioned antibodies or antigen-binding fragments of the present invention for pharmaceutical compositions, they may be formulated by methods known to those skilled in the art. For example, as necessary, they can be prepared in the form of injectable sterile solutions or suspensions using water or another pharmaceutically acceptable liquid, and can be administered parenterally. For example, the antibodies or antigen-binding fragments to be included in the pharmaceutical compositions can be combined with pharmaceutically acceptable carriers or media, specifically, sterile water, physiological saline, vegetable oils, emulsifiers, suspensions, surfactants, stabilizers, flavoring agents, excipients, solvents, preservatives, binders, or such, and mixed into a unit dose form required for generally accepted pharmaceutical practice. The phrase "pharmaceutically acceptable" indicates that the substance is inactive, and contains conventional substances used as diluents or vehicles for pharmaceuticals. Suitable excipients and their formulations are described, for example, in Remington's Pharmaceutical Sciences, 16th ed. (1980) Mack Publishing Co., ed. Oslo et al.

Physiological saline and other isotonic solutions containing glucose or adjuvants (for example, D-sorbitol, D-mannose, D-mannitol, and sodium chloride) can be used as aqueous solutions for injection. They can be used together with appropriate solubilizers such as alcohols, more specifically, ethanol and polyalcohols (propylene glycol, polyethylene glycol, and such), and non-ionic surfactants (Polysorbate 80™, HCO-50, and such).

Sesame oil or soybean oil can be used as an oleaginous liquid, and benzyl benzoate or benzyl alcohol can be used in combination as a solubilizer. Buffers (for example, phosphate buffer and sodium acetate buffer), soothing agents (for example, procaine hydrochloride), stabilizers (for example, benzyl alcohol and phenol), and antioxidants can be used for the formulations. Prepared injection solutions can be filled into appropriate ampules.

The administration is preferably parenteral administration, and specific examples include administration by injection, transnasal administration, transpulmonary administration, and transdermal administration. Examples of administration by injection include systemic and local administration by intravenous injection, intramuscular injection, intraperitoneal injection, subcutaneous injection, and such.

The pharmaceutical compositions contain a pharmaceutically effective amount or therapeutically effective amount of the active component (the above-mentioned antibody of the present invention). "Pharmaceutically effective amount" or "therapeutically effective amount" refers to an amount sufficient for treating and/or preventing disorders in which antigens for the above-mentioned antibodies of the present invention play an important role. For example, "a pharmaceutically effective amount" or "therapeutically effective amount" may be an amount required for reducing A beta accumulation, neutralizing A beta-induced toxicity, reducing A beta fibril formation, or such, thereby treating or preventing conditions caused by Alzheimer's disease, when the above-described antibody or antigen-binding fragment of the present invention is administered to individuals (patients). The reduction or neutralization may be, for example, a reduction or neutralization of at least approximately 5%, 10%, 20%, 30%, 40%, 50%, 75%, 80%, 90%, 95%, 99%, or 100%.

Assessment for determining such a pharmaceutically effective amount of the above-mentioned antibodies or antigen-binding fragments of the present invention may be carried out using a standard clinical protocol including histopathological diagnosis.

A suitable administration method may be selected depending on the age and symptoms of the patient. The dosage of an antibody-containing pharmaceutical composition may be selected, for example, within the range of 0.0001 mg to 1000 mg per kilogram body weight for each administration. Alternatively, for example, the dosage for each patient may be selected within the range of 0.001 to 100,000 mg/body; however, the dosage is not necessarily limited to these ranges. Although the dosage and administration methods vary depending on the patient's body weight, age, symptoms, and such, one skilled in the art can appropriately select them. The dosage may be selected based on the high-dose intravenous immunoglobulin therapy (400 mg/kg) covered by health insurance for humans.

In the present invention, the pharmaceutical compositions or agents comprising an antibody or antigen-binding fragment of the present invention may be included in products and kits containing materials useful for treating pathological conditions of a subject. The products may comprise any labeled container for a compound. Suitable containers include bottles, vials, and test tubes. The containers may be formed from a variety of materials such as glass and plastic. The label on the container surface should indicate that the composition is used to treat or prevent one or more conditions of the disease. The label may also indicate descriptions for administration, and such.

In addition to the above-mentioned container, a kit containing a pharmaceutical composition or agent comprising an antibody or antigen-binding fragment may optionally include a second container that stores a pharmaceutically acceptable diluent. The kit may further include other materials desirable from a commercial and user's standpoint, including other buffers, diluents, filters, needles, syringes, and package inserts with descriptions for use.

If necessary, the pharmaceutical compositions may be provided in a pack or dispenser device that may contain one or more unit dosage forms comprising an active ingredient. The pack may comprise metal or plastic foil, and, for example, it is a blister pack. The pack or dispenser device may be accompanied by instructions for administration.

In the above-mentioned pharmaceutical agents and kits, besides the antibody or antigen-binding fragment of the present invention that is an active ingredient, sterile water, physiological saline, vegetable oils, surfactants, lipids, solubilizing agents, buffers, protein stabilizers (BSA, gelatin, etc.), preservatives, blocking solutions, reaction solutions, reaction quenching solutions, reagents for treating samples, and such, may be mixed as necessary.

Furthermore, the present invention provides methods for detecting A beta oligomers (examples include A beta40 (A beta 1-40), A beta42 (A beta 1-42) oligomers, and A beta40/A beta42 oligomers) in samples (specimens). Examples of "samples" of the present invention include samples collected from subjects, cell culture supernatants, cell extracts, samples collected from subject animals, or such; however, they are not particularly limited as long as they contain A beta oligomers. Specifically, the present methods include the step of detecting A beta oligomers contained in a sample (e.g., a sample collected from a subject) using an antibody or antigen-binding fragment of the present invention. A beta oligomers in a sample can be detected by common immunological detection methods, for example, using ELISA (sandwich solid-phase enzyme immunoassay methods that use chemiluminescence (chemiluminescence ELISA), etc.), RIA, immunoprecipitation methods that use the obtained antibodies, immunoblotting, flow cytometry, mass spectrometry, and immunohistochemical analysis.

When A beta oligomers are detected in a sample collected from a subject by the above-mentioned measurement methods, the subject is a possible Alzheimer's disease patient (WO2009/051220, WO2009/099176, U.S. Ser. No. 12/533, 294, and U.S. Ser. No. 12/533,348). Thus, the present invention also provides methods of diagnosing whether a subject is a possible Alzheimer's disease patient. For example, when the amount of A beta oligomers in a sample collected from a subject is compared with that from a healthy individual, and if the amount of A beta oligomers is greater in the subject than in the healthy individual, the subject is determined to be a possible Alzheimer's disease patient. Whether or not a subject is a possible Alzheimer's disease patient is diagnosed usually by physicians (including individuals under instructions from physicians; same herein below). Data on the amount of A beta oligomers in samples collected from a subject and a healthy individual, which are obtained by the present methods of diagnosis, will be useful for diagnosis by physicians. Therefore, the present methods of diagnosis can be expressed as methods of collecting and presenting data useful for diagnosis by physicians. Furthermore, "a method of diagnosing whether or not a subject is a possible Alzheimer's disease patient" is alternatively expressed as "a method of diagnosing whether or not a subject suffers from Alzheimer's disease, or is at a risk of developing Alzheimer's disease".

Specifically, the present invention provides methods for diagnosing whether or not a subject is a possible Alzheimer's disease patient, wherein the methods comprise detecting A beta oligomers in a sample collected from the subject using an antibody or antigen-binding fragment of the present invention.

More specifically, the present invention provides a method of diagnosing whether or not a subject is a possible Alzheimer's disease patient, which comprises the steps of:

(a) contacting a sample collected from a subject with the antibody or antigen-binding fragment of the present invention; and (b) measuring the amount of A beta oligomer in the sample, wherein the subject is determined to be a possible Alzheimer's disease patient, when the amount measured in step (b) is higher than that of a healthy individual. Step (b) above can be alternatively expressed as "the step of detecting an A beta oligomer in the sample via the antibody or antigen-binding fragment of the present invention that has bound to an A beta oligomer in the sample".

Furthermore, the present invention provides methods of diagnosing whether or not a subject is a possible Alzheimer's disease patient, which comprise the steps of:

(a) contacting a sample collected from a subject with an antibody or antigen-binding fragment of the present invention and an antibody or antigen-binding fragment that binds to an A beta monomer; and (b) measuring the ratio of A beta oligomer to A beta monomer in the sample, wherein the subject is determined to be a possible Alzheimer's disease patient, if the ratio measured in step (b) is higher than that of a healthy individual.

First, in the present methods, a sample collected from a subject is contacted with an antibody or antigen-binding fragment of the present invention and an antibody or antigen-binding fragment that binds to an A beta monomer. Herein, "contact" may be carried out, for example, by adding each of the above-mentioned antibodies or antigen-binding fragments to a sample collected from a subject, which is placed in a test tube. In this case, the antibody or antigen-binding fragment is added suitably in the form of a solution, a solid obtained by freeze-drying, or such. When adding the antibody as an aqueous solution, the solution may purely contain the antibody alone, or may contain, for example, surfactants, excipients, coloring agents, flavors, preservatives, stabilizers, buffers, suspending agents, tonicity agents, binding agents, disintegrants, lubricants, fluidity promoters, or corrigents. The concentration at which the antibody is added is not particularly limited. For example, as with human immunoglobulin formulations, 500-mg, 1000-mg, and 2500-mg freeze-dried formulations and such may be suitably used. "Contact" may be performed, for example, by adding a sample to a carrier on which the above antibody or antigen-binding fragment has been immobilized. Preferred examples of the carrier on which the above antibody or antigen-binding fragment is immobilized include, for example, microplates, beads (magnetic beads, Sepharose beads, etc.

Next, the ratio of A beta oligomer to A beta monomer (herein, this is also referred to as "O/M index") in the aforementioned sample is measured. To measure this ratio, the measurement can be carried out using a method of comparing the oligomer and monomer ELISA values obtained from the same sample.

Then, this ratio is compared with the ratio for a healthy individual. When the ratio is higher in the subject than in the healthy individual, the subject is determined to be a possible Alzheimer's disease patient.

The methods of diagnosis of the present invention can be performed both in vitro and in vivo, but they are preferably performed in vitro.

Preferably, the "sample collected from a subject" of the present invention is not particularly limited as long as it is a tissue derived from a subject. Examples include the brain (brain parenchyma, and such), organs, and body fluids (blood, cerebrospinal fluid, and such) of a subject. In the present invention, the sample is preferably blood (more preferably, plasma) or cerebrospinal fluid. The "sample collected from a subject" includes a sample treated with an enzyme, treated using a column, treated by centrifugation, treated by extraction, after collection.

When the sample is a brain tissue, frozen tissue samples from the brain tissue may be homogenized and subjected to ultracentrifugation or such, to separate buffer-soluble fractions and buffer-insoluble fractions and measure A beta oligomers. For example, a brain tissue is homogenized in nine volumes of Tris-buffered saline (TS) containing a protease inhibitor cocktail, and the homogenates are ultracentrifuged at 265,000×g for 20 minutes. Then, a collected supernatant as a soluble fraction of the brain tissue can be used as a sample for immunoblotting, ELISA, RIA, immunoprecipitation, etc. A buffer-insoluble fraction may be solublized by formic acid (e.g., 70%) extraction, and used as a sample for immunoblotting, ELISA, RIA, immunoprecipitation, etc. Formic acid extracts may be appropriately neutralized or diluted with a buffer (e.g., 1 M Tris-HCl (pH 8.0)).

When A beta oligomers present in a brain tissue are visualized and measured by immunohistochemical methods, brain tissue sections from a subject can be used as samples. To enhance the immunoreactivity, the brain tissue sections can be pre-treated with Protease K. In immunohistochemical methods, it is not essential to quantify A beta oligomers in brain tissues. For example, if A beta deposition is observed, the subject is determined to be a possible Alzheimer's disease patient.

To increase the accuracy of A beta oligomer measurements, lipoproteins may be removed from a subject-derived sample. The depletion of lipoproteins can be performed by, for example, combining ultracentrifugation, ultrafiltration, and affinity chromatography. A specific method of depleting lipoproteins from a sample is exemplified below, but not limited thereto.

The density of a sample is adjusted to 1.25 g/ml with KBr. The sample is ultracentrifuged at 100,000 rpm and 16 degrees C. for eight hours. Lipoproteins floating at a density of 1.25 g/ml and lipoprotein-depleted clarified fluid are subjected to ultrafiltration using a 3 kDa cut-off membrane (Microcon 3; Arnicon, Inc), and then frozen and stored, or stored at 4 degrees C., until use. Lipoproteins are also removed by affinity chromatography using PHML-LIPOSORB (Calbiochem, La Jolla, Calif.). A sample and PHML-LIPOSORB (Calbiochem, La Jolla, Calif.) are combined at a ratio of 1.5:1, and mixed for 60 seconds. Then, the mixture is centrifuged at 3,000 rpm for ten minutes. The resulting supernatants can be used as lipoprotein-free samples. The lipoprotein-bound samples bound to PHML-LIPOSORB are eluted using 20 mM sodium deoxycholate. The removal of specific lipoproteins can be confirmed by 1% agarose gel electrophoresis, followed by staining with FAST-RED 7B (Wako, Osaka, Japan).

Furthermore, by size fractionation of A beta oligomers in a sample using size exclusion chromatography, ultrafiltration, or such, and subsequent detection of A beta oligomers in each fraction using the antibody or antigen-binding fragment of the present invention, the amount of A beta oligomer of each size in the sample can be measured. Fractionation by size exclusion chromatography can be performed by concentrating a subject-derived sample about ten-fold using a Microcon 3 kDa molecular weight cut-off filter (Millipore Corp.), and then applying the sample to a Superose 12 size exclusion column (1 cm×30 cm; Pharmacia Biotech., Uppsala, Sweden; flow rate of 0.5 ml/min) equilibrated with a phosphate buffer. Alternatively, fractionation by ultrafiltration can be performed by sequential ultrafiltration using Microcon 3 kDa, 10 kDa, 30 kDa, and 100 kDa cut-off membranes. The amount of A beta oligomer contained in each fraction can be measured by ELISA, RIA, immunoblotting, immunoprecipitation, etc.

The methods of measuring an A beta oligomer of the present invention are not particularly limited as long as they comprise the step of detecting an A beta oligomer in a sample using the antibodies or antigen-binding fragments of the present invention. Preferable methods include sandwich ELISA. When sandwich ELISA is performed, an antibody or antigen-binding fragment of the present invention may be immobilized or labeled. Alternatively, an antibody or antigen-binding fragment of the present invention may be used as a primary antibody, and a labeled secondary antibody can be bound to it. The other antibody used in sandwich ELISA may be an antibody or antigen-binding fragment of the present invention, or may be a commercially available anti-A beta antibody. A specific method of detecting A beta oligomers in a sample by sandwich ELISA is exemplified below, but not limited thereto.

Microplates are coated with an antibody or antigen-binding fragment of the present invention, and 100 micro l of a sample is added and incubated continuously for 24 hours at 4 degrees C. Then, horseradish peroxidase-conjugated BA27 Fab' fragment (anti-A beta 1-40 specific to A beta 40; Wako pure chemical, Osaka, Japan) or horseradish peroxidase-conjugated BCO5 Fab' fragment (anti-A beta 35-43 specific to A beta 42; Wako pure chemical, Osaka, Japan) is added and incubated at 4 degrees C. for 24 hours. The chemiluminescence generated using SuperSignal ELISA Pico Chemiluminescent Substrate (Pierce, Rockford, Ill., USA) is quantified by a Veritas Microplate Luminometer (Promega).

Furthermore, if a sample is immunoprecipitated using an antibody of the present invention, and then immunoblotting analysis is performed, the size of A beta oligomer contained in a sample can be identified without carrying out size fractionation by size exclusion chromatography, ultrafiltration, or such. A specific method is exemplified below, but not limited thereto.

Immunoprecipitation is conducted by incubating a sample with an antibody of the present invention and Protein G-Sepharose. The immunoprecipitated A beta oligomers are separated using an NuPAGE 4-12% Bis-Tris-Glycine gel, and transferred onto a nitrocellulose membrane or Immobilon P (Millipore) using 10 mM 3-cyclohexylamino-1-propane sulfonic acid (pH 11) containing 10% methanol at 400 mA for one hour. Non-specific binding sites on the membrane were blocked with a phosphate buffer containing 5% low-fat milk, 1% BSA, and 0.05% Tween-20 at room temperature for three hours. The A beta oligomers are detected by reaction with an antibody of the present invention, or a commercially available anti-A beta antibody such as 4G8 or 6E10 (Covance Immuno-Technologies, Dedham, Mass.).

Furthermore, to quantify the amount of A beta oligomer in a sample, a calibration curve may be prepared using standard samples containing a known concentration of A beta oligomer. A beta oligomers used for preparation of standard samples can be prepared by diluting a synthetic A beta (HCl form) dissolved in an HCl solution with PBS or such to a suitable concentration (e.g., 0.1 mg/ml), and incubating at 37 degrees C. for an hour. The incubation temperature and time for synthetic A beta can be suitably selected. In the methods of the present invention, to obtain the ratio of A beta oligomer to A beta monomer, a calibration curve may be also prepared for A beta monomers. A beta monomers used for preparation of standard A beta monomer samples can be prepared by diluting a synthetic A beta (TFA form) dissolved in TFA (trifluoroacetic acid) with PBS or such to a suitable concentration (e.g., 0.1 mg/ml). For synthetic A beta, A beta 1-40, A beta 1-42, or such can be used.

Furthermore, the present invention provides agents (reagents) or kits for use in the above-mentioned methods of measuring A beta oligomers in a sample, or methods of diagnosing whether or not a subject is a possible Alzheimer's disease patient.

The agents for use in the above-mentioned methods of measuring A beta oligomers, or methods of diagnosing whether or not a subject is a possible Alzheimer's disease patient include agents comprising an antibody or antigen-binding fragment of the present invention. In a preferred embodiment, the agents include antibody solutions and immobilized antibodies; however, they are not limited thereto. When the agents are in a form of antibody solution, an antibody or antigen-binding fragment of the present invention is being dissolved in a suitable solvent. Those skilled in the art can select suitable solvents for dissolving the antibody or antigen-binding fragment of the present invention such as water, physiological saline, phosphate buffer, Tris buffer, etc. The above antibody solution of the present invention may comprise, in addition to an antibody of the present invention, a buffer, protein stabilizing agent, preservative agent, blocking agent, surfactant, solubilizing agent, or such, as necessary.

When the agent of the present invention is an immobilized antibody, the antibody or antigen-binding fragment of the present invention is being carried by a suitable carrier. Examples of the carrier include microplates, beads (magnetic beads, Sepharose beads, etc.), nitrocellulose membranes, and such; however, they are not limited thereto. Those skilled in the art can select suitable carriers for immobilizing the antibodies of the present invention. Antibodies or antigen-binding fragments of the present invention can be bound to carriers using known methods.

Antibodies or antigen-binding fragments of the present invention comprised in the agents may be suitably labeled with an enzyme label, radioactive label, fluorescent label, dye label, chemical luminescence label, etc.

The kits for use in the above-mentioned methods of measuring A beta oligomers, or methods of diagnosing whether or not a subject is a possible Alzheimer's disease patient include kits comprising agents comprising an antibody or antigen-binding fragment of the present invention. Preferable examples of agents comprising an antibody or antigen-binding fragment of the present invention are as mentioned above. The kits may comprise an antibody or antigen-binding fragment of the present invention in a form of lymphilized powder. In this case, kit users dissolve the lymphilized powder of antibody or antigen-binding fragment with a suitable solvent.

The kits may comprise such a solvent for dissolving the antibody or antigen-binding fragment. The kits further comprise a dilution solution for diluting the above-mentioned antibody solutions.

The kits may comprise, in addition to an agent comprising an antibody or antigen-binding fragment of the present invention, a reagent such as blocking agent, chromogenic reagent, chromogenic substrate, reaction termination solution, washing solution, buffer, primary antibody, secondary antibody, or such, as necessary. Those skilled in the art can select a suitable reagent depending on the A beta oligomer measurement method. For example, a sandwich ELISA kit comprising a microplate on which the antibody is immobilized may further comprise a labeled anti-A beta antibody, chromogenic substrate, reaction termination solution, washing solution, plate seal, etc. Furthermore, in a sandwich ELISA kit comprising an antibody solution of the present invention may further comprise a microplate on which an anti-A beta antibody is immobilized, chromogenic substrate, reaction termination solution, washing solution, plate seal, labeled secondary antibody (if the antibody of the present invention is not labeled), etc.

The kits may further comprise a standard sample for preparing a calibration curve of A beta oligomer. The standard sample may be a solution containing a known concentration of A beta oligomer. The kits may comprise a diluting solution for stepwise dilution of the standard solution. Alternatively, lymphilized powder of A beta oligomers may be included, and a solvent for dissolving the lymphilized powder may be comprised. Furthermore, the kits may comprise a solution or lymphilized powder of an A beta monomer, and kit uses may prepare an A beta oligomer standard solution by incubating the A beta monomer solution to polymerize A beta monomers.

When the kits are for use in methods of diagnosing whether or not a subject is a possible Alzheimer's disease patient, they may comprise a sample (a brain tissue, cerebrospinal fluid, blood, plasma, etc.) collected from a healthy individual as a negative control, and a sample collected from a AD brain patient as a positive control.

The kit may further include other materials desirable from a commercial and user's standpoint, including buffers, diluents, filters, needles, syringes, and attached documents including descriptions for use (instructions, CD-ROM, etc.). The agents and such contained in the kit may be included in a container with a label. Such a container includes a bottle, vial, test tube, microtube, etc.

All prior art references cited herein are incorporated by reference into this description.

EXAMPLES

Hereinbelow, the present invention is specifically described with reference to the Examples, but it is not to be construed as being limited thereto.

Methods

Preparation of Antigens

A fluorescent dye, 6-carboxytetramethylrhodamine (6-TAMRA) (SIGMA) was chemically linked to the N terminus of a synthetic A beta 1-40 peptide (Peptide Institute, Inc.) to produce a modified A beta. An oligomer-rich sample (A beta 1-40 oligomer) was prepared by copolymerizing the modified A beta and synthetic A beta 1-40 peptide. It is preferable to adjust the conditions so that the fluorescence intensity determined by ThT assay (Yamamoto N, et al: J Biol Chem, 282: 2646-2655, 2007), which is described below, is one-fourth or less the fluorescence intensity in the absence of a modified A beta. More specifically, it is preferred that 100 micro M each of the modified A beta and synthetic A beta 1-40 peptide are mixed, and polymerized for 20 hours.

Preparation of Antibody-Producing Hybridomas

BALB/c mice were immunized by injecting the antigen prepared by the method described above into their foot pads or abdominal cavities. Then, booster immunization was carried out six times. Hybridomas were prepared from inguinal lymph node cells or spleen cells by fusion with Sp2/O—Ag14 cells using Polyethylene Glycol 1500.

ELISA Screening (Primary Screening)

Hybridoma culture supernatants were added to ELISA plates immobilized with A beta oligomers and reacted. Color development was carried out using an HRP-conjugated anti-mouse IgG antibody and TMB solution. A beta oligomers used in this method is A beta1-40 (HCl form) after one hour incubation or above-described extracted antigens of A beta1-42 tetramer.

Dot Blot Analysis (Secondary Screening)

Dot blot analysis was carried out for hybridomas that gave positive result for primary screening. In this analysis, 0.1 micro g/dot of three types of A beta; synthesized A beta 1-40 (TFA form) as A beta monomer, synthesized A beta1-40 (HCl form) after 1 hour incubation as A beta oligomer, and synthesized A beta1-42, were immobilized onto nitrocellulose membrane and used. The membrane was blocked with Tris Buffer containing 5% low-fat milk and 0.05% Tween-20, and reacted with hybridoma culture supernatants and detected using an HRP-conjugated anti-mouse IgG antibody and a chemiluminescence kit (ECL).

Antibody Isotyping

Isotyping of purified immunoglobulins were carried out using a Serotec (Oxford, UK) Mouse Monoclonal Antibody Isotyping Test Kit.

Identification of Antibody Sequences

RNAs were purified from hybridomas ($1 \times 10^6$ cells) produced by the method described above using FastPure RNA Kit (TaKaRa, Japan). Using the RNAs as templates, cDNAs were synthesized using 5' RACE System (Invitrogen, USA) and primers specific to H chains or L chains of antibodies that are produced from each hybridomas. 3' side primer sequences that were used for cDNA syntheses are shown below.

```
                                     (SEQ ID NO: 2964)
H chain (G1) mIGC1Rv:
AAGGCTTACAACCACAATCCCT (SEQ ID NO: 2965)
H chain (G2a) mIGC2aRv:
TGCTGGGCATTTGCATGGA (SEQ ID NO: 2966)
H chain (G2b) mIGC2bRv:
TGGGCATTTGTGACACTCC (SEQ ID NO: 2967)
H chain (G3) mIGC3Rv:
ACTGGGCTTGGGTATTCTAGG (SEQ ID NO: 2968)
L chain (kappa) mIKCNRv1:
GTCCAACTGTTCAGGACGCCATTTTGTCGTT (SEQ ID NO: 2969)
L chain (lambda) mILCNRv1:
TCCACAGTGTGACCTTCATGAGTGACC
```

Furthermore, using the cDNAs, VH and VL regions were amplified by PCR method. 3' side primer sequences specific to H chains or L chains used for PCR are shown below.

```
H chain mIGCNRv:              (SEQ ID NO: 2970)
ACAGGGATCCAGAGTTCCA

L chain (kappa) mIKCNRv2:     (SEQ ID NO: 2971)
TAACTGCTCACTGGATGG

L chain (lambda) mILCNRv2:    (SEQ ID NO: 2972)
AGTGTGGCCTTGTTAGTCTCGAGC
``` cDNA syntheses and PCR were carried out according to the manual attached to the product, and primers attached to the product (AAP: GGCCACGCGTCGACTAG-TACGGGGGGGGGG (SEQ ID NO: 2973), AUAP: GGC-CACGCGTC-GACTAGTAC (SEQ ID NO: 2974)) were used as 5' side primers. Taq DNA polymerase High Fidelity (Invitrogen, USA) was used for PCR.

VH and VL region fragments amplified by PCR was ligated with linear vector (pGEMTM-T Easy Vector (Promega, USA)) for one hour and transformed into *E. coli* DH5alpha strain. Formed colonies were cultured overnight in a liquid selection medium and plasmids were purified using High Purity Plasmid Miniprep System (MARIGEN BIOSCIENCES, USA). Antibody sequences were determined by gene sequence analysis using BigDye Terminator V3.1 Cycle Sequence Kit (Applied Biosystems) and 3730x1 DNA Analyzer (Applied Biosystems). Two primers described below were used for sequence analysis.

```
SP6:    CGCCAGGGTTTTCCCAGTCACGAC      (SEQ ID NO: 2975)

M13Rv:  TCACACAGGAAACAGCTATGAC        (SEQ ID NO: 2976)
```

Control Antibodies

Anti-A beta antibody 6E10 was used as a control antibody to compare to the antibodies of the present invention. Anti-A beta antibody 6E10 (Covance Immuno-Technologies, Dedham, Mass.) is a mouse monoclonal antibody that recognizes a sequence in A beta1-16 as an epitope, and has no selectivity against A beta oligomer (binds to A beta monomer).

Competitive ELISA

A beta oligomer antigens were prepared by diluting synthetic A beta1-40 (HCl form) at 0.1 mg/ml with PBS and incubating at 37 degrees C. for one hour. A beta monomer was prepared by diluting synthetic A beta1-40 (TFA form) at 0.1 mg/ml with PBS. First, 400 ng/well of A beta oligomer was immobilized onto 96-well immunopate and the plate was blocked with BSA. Next, antibodies of the present invention or a control anti-A beta antibody (6E10) were each mixed with serially-diluted A beta monomer or A beta oligomer at a range of 100 pg/ml to 100 micro g/ml and incubated for two hours, then each mixture was added to 96-well immunoplate and incubated at room temperature for ten minutes. Binding abilities of each antibodies to immobilized A beta oligomer were detected by reacting with HRP-conjugated anti-mouse IgG antibody and visualized by measuring absorbance at 450 nm using TMB solution. In the present method, two types of A beta1-40 (A beta1-40 monomer and A beta1-40 oligomer), which have the same sequence but have different structure and polymerization characters due to their structure, was compared as competitive substance. Accordingly, the method can compare the binding difference of the antibodies only derived from the existence of A beta1-40 polymerization, and thus can obtain extremely reliable results.

Analysis of Affinity to A Beta Oligomer

The analysis was carried out by Surface Plasmon Resonance (SPR) using Biacore 3000 (GE Healthcare Sciences). A beta oligomer was immobilized onto a sensor chip (CM5) as a ligand and antibodies of the present invention and control 6E10 antibody were used as analyte, kinetics analysis was carried out. Analysis was conducted at analyte antibodies at the following five concentrations: 1.25, 2.50, 5.00, 10.00, and 20.00 micro g/ml, and association rate constant (ka), dissociation rate constant (kd), and dissociation constant (KD) was calculated using BiaEvaluation software. A beta oligomer used in the analysis was prepared by diluting synthetic A beta1-40 (HCl form) at 0.1 mg/ml with PBS and incubating at 37 degrees C. for one hour.

A Beta-Induced Neurotoxicity Assay

Human neuroblastoma cell (SH-SY5Y cell) was plated into 24-well plates at a density of 150,000 cells/well, and cultured for 24 hours in DMEM containing 10% FBS. Then, the medium was replaced a serum-free medium containing 12.5 micro M A beta1-42 in the presence or absence of antibodies and cells were cultured for another 24 hours. To determine the cytotoxicity induced by A beta1-42, LDH contents released into the medium from dead cells was determined using CytoTox96 Kit (manufactured by Promega).

Activity of Suppressing A Beta Amyloid Fibril Formation

A beta1-42 solution diluted to 12.5 micro M with cell culture medium was incubated in the presence or absence of antibodies of the present invention at 37 degrees C. for 24 hours. Then, the solutions were mixed with Thioflavin T (ThT) solution (5 micro M ThT, 50 mM Glycine-NaOH, pH8.5), ThT fluorescence intensity, which is correlated with A beta amyloid fibril contents, were determined using fluorescence spectrophotometer (RF-5300PC; Shimadzu Co., Kyoto, Japan). Excitation and emission wavelengths were set at 446 nm and 490 nm, respectively. Fluorescence intensity was measured immediately after the mixture was prepared.

Immunoblotting

Brain homogenates of Tg2576 or wild type mice were used for APP binding assay. The homogenates were electrophoresed in NuPAGE Tris-Glycine 4-12% gel and transferred to a PVDF membrane. The membrane was reacted to each antibodies after blocking by PVDF blocking reagent (TOYOBO). The binding ability was detected by an HRP-conjugated anti-mouse IgG antibody and a chemiluminescent regent (Immobilon western, Millipore).

Result

Selection of Anti-A Beta Oligomer Antibodies 46 mice were immunized with A beta 1-40 oligomer antigen and inguinal lymph node or spleen were isolated from each mice. Cells derived from each organs were fused with myeloma (Sp2/O—Ag14) and dispensed into seven plates of 96-well plate per mice and cultured. Hybridomas producing the antibodies of interest were selected by adding culture supernatant from the 96-well plate onto ELISA plates immobilized with A beta oligomer, and reacting them to analyze. As a result, 507 positive cells were selected from 30,912 wells ((46 mice)×(7 plates)×(96 wells)).

The above-described ELISA screening also select antibodies that do not specifically bind to A beta oligomer (antibodies that bind to ELISA plate other than A beta oligomer). By performing dot blot analysis, these non-specific antibodies can be excluded. Accordingly, dot blot analysis using ELISA-positive cells were carried out. For dot blot analysis, two types of oligomers and A beta monomer were spotted and excluded non-specific antibodies (antibodies that do not bind to the spotted A beta oligomer were excluded), as well as specificity against A beta oligomer (absence of binding to A beta monomer) was confirmed. As a result, 145 positive antibodies among 507 ELISA-positive cells were selected (FIG. 1).

Identification of Antibody Sequences

The variable region sequences were analyzed by the above-mentioned method, for 145 antibodies selected by the above dot blot analysis. As a result, the following nucleotide sequences of regions comprising VH CDR1, CDR2, and CDR3 were obtained:

SEQ ID NO: 1 (IR-001), SEQ ID NO: 17 (IR-002), SEQ ID NO: 33 (IR-004), SEQ ID NO: 49 (IR-005), SEQ ID NO: 65 (IR-006), SEQ ID NO: 81 (IR-007), SEQ ID NO: 97 (IR-008), SEQ ID NO: 113 (IR-011), SEQ ID NO: 129 (IR-012), SEQ ID NO: 145 (IR-013), SEQ ID NO: 161 (IR-014), SEQ ID NO: 177 (IR-015), SEQ ID NO: 193 (IR-017), SEQ ID NO: 209 (IR-020), SEQ ID NO: 225 (IR-021), SEQ ID NO: 241 (IR-022), SEQ ID NO: 257 (IR-023), SEQ ID NO: 273 (IR-024), SEQ ID NO: 289 (IR-025), SEQ ID NO: 305 (IR-026), SEQ ID NO: 321 (IR-027), SEQ ID NO: 337 (IR-028), SEQ ID NO: 353 (IR-029), SEQ ID NO: 369 (IR-030), SEQ ID NO: 385 (IR-031), SEQ ID NO: 401 (IR-032), SEQ ID NO: 417 (IR-033), SEQ ID NO: 433 (IR-034), SEQ ID NO: 449 (IR-035), SEQ ID NO: 465 (IR-036), SEQ ID NO: 481 (IR-037), SEQ ID NO: 497 (IR-038), SEQ ID NO: 513 (IR-039), SEQ ID NO: 529 (IR-040), SEQ ID NO: 545 (IR-041), SEQ ID NO: 561 (IR-043), SEQ ID NO: 577 (IR-044), SEQ ID NO: 593 (IR-045), SEQ ID NO: 609 (IR-046), SEQ ID NO: 625 (IR-048), SEQ ID NO: 641 (IR-049), SEQ ID NO: 657 (IR-050), SEQ ID NO: 673 (IR-051), SEQ ID NO: 689 (IR-052), SEQ ID NO: 705 (IR-053), SEQ ID NO: 721 (IR-054), SEQ ID NO: 737 (IR-055), SEQ ID NO: 753 (IR-056), SEQ ID NO: 769 (IR-057), SEQ ID NO: 785 (IR-058), SEQ ID NO: 801 (IR-059), SEQ ID NO: 817 (IR-060), SEQ ID NO: 833 (IR-061), SEQ ID NO: 849 (IR-062), SEQ ID NO: 865 (IR-063), SEQ ID NO: 881 (IR-064), SEQ ID NO: 897 (IR-065), SEQ ID NO: 913 (IR-066), SEQ ID NO: 929 (IR-067), SEQ ID NO: 945 (IR-068), SEQ ID NO: 961 (IR-069), SEQ ID NO: 977 (IR-070), SEQ ID NO: 993 (IR-071), SEQ ID NO: 1009 (IR-072), SEQ ID NO: 1025 (IR-073), SEQ ID NO: 1041 (IR-074), SEQ ID NO: 1057 (IR-075), SEQ ID NO: 1073 (IR-076), SEQ ID NO: 1089 (IR-077), SEQ ID NO: 1105 (IR-078), SEQ ID NO: 1121 (IR-079), SEQ ID NO: 1137 (IR-080), SEQ ID NO: 1153 (IR-081), SEQ ID NO: 1169 (IR-082), SEQ ID NO: 1185 (IR-083), SEQ ID NO: 1201 (IR-084), SEQ ID NO: 1217 (IR-085), SEQ ID NO: 1233 (IR-086), SEQ ID NO: 1249 (IR-087), SEQ ID NO: 1265 (IR-088), SEQ ID NO: 1281 (IR-089), SEQ ID NO: 1297 (IR-090), SEQ ID NO: 1313 (IR-092), SEQ ID NO: 1329 (IR-093), SEQ ID NO: 1345 (IR-094), SEQ ID NO: 1361 (IR-095), SEQ ID NO: 1377 (IR-097), SEQ ID NO: 1393 (IR-098), SEQ ID NO: 1409 (IR-100), SEQ ID NO: 1425 (IR-101), SEQ ID NO: 1441 (IR-102), SEQ ID NO: 1457 (IR-104), SEQ ID NO: 1473 (IR-105), SEQ ID NO: 1489 (IR-106), SEQ ID NO: 1505 (IR-107), SEQ ID NO: 1521 (IR-108), SEQ ID NO: 1537 (IR-109), SEQ ID NO: 1553 (IR-110), SEQ ID NO: 1569 (IR-112), SEQ ID NO: 1585 (IR-114), SEQ ID NO: 1601 (IR-115), SEQ ID NO: 1617 (IR-116), SEQ ID NO: 1633 (IR-117), SEQ ID NO: 1649 (IR-118), SEQ ID NO: 1665 (IR-119), SEQ ID NO: 1681 (IR-120), SEQ ID NO: 1697 (IR-121), SEQ ID NO: 1713 (IR-122), SEQ ID NO: 1729 (IR-123), SEQ ID NO: 1745 (IR-124), SEQ ID NO: 1761 (IR-125), SEQ ID NO: 1777 (IR-126), SEQ ID NO: 1793 (IR-127), SEQ ID NO: 1809 (IR-128), SEQ ID NO: 1825 (IR-129), SEQ ID NO: 1841 (IR-131), SEQ ID NO: 1857 (IR-132), SEQ ID NO: 1873 (IR-133), SEQ ID NO: 1889 (IR-134), SEQ ID NO: 1905 (IR-135), SEQ ID NO: 1921 (IR-136), SEQ ID NO: 1937 (IR-137), SEQ ID NO: 1953 (IR-138), SEQ ID NO: 1969 (IR-139), SEQ ID NO: 1985 (IR-140), SEQ ID NO: 2001 (IR-141), SEQ ID NO: 2017 (IR-142), SEQ ID NO: 2033 (IR-143), SEQ ID NO: 2049 (IR-144), SEQ ID NO: 2065 (IR-145), SEQ ID NO: 2081 (IR-146), SEQ ID NO: 2097 (IR-147), SEQ ID NO: 2113 (IR-149), SEQ ID NO: 2129 (IR-150), SEQ ID NO: 2145 (IR-151), SEQ ID NO: 2161 (IR-152), SEQ ID NO: 2177 (IR-153), SEQ ID NO: 2193 (IR-154), SEQ ID NO: 2209 (IR-155), SEQ ID NO: 2225 (IR-156), SEQ ID NO: 2241 (IR-157), SEQ ID NO: 2257 (IR-158), SEQ ID NO: 2273 (IR-159), SEQ ID NO: 2861 (IR-160), and SEQ ID NO: 2877 (IR-161). From the above nucleotide sequence, the following amino acid sequences were obtained:

SEQ ID NO: 2 (IR-001), SEQ ID NO: 18 (IR-002), SEQ ID NO: 34 (IR-004), SEQ ID NO: 50 (IR-005), SEQ ID NO: 66 (IR-006), SEQ ID NO: 82 (IR-007), SEQ ID NO: 98 (IR-008), SEQ ID NO: 114 (IR-011), SEQ ID NO: 130 (IR-012), SEQ ID NO: 146 (IR-013), SEQ ID NO: 162 (IR-014), SEQ ID NO: 178 (IR-015), SEQ ID NO: 194 (IR-017), SEQ ID NO: 210 (IR-020), SEQ ID NO: 226 (IR-021), SEQ ID NO: 242 (IR-022), SEQ ID NO: 258 (IR-023), SEQ ID NO: 274 (IR-024), SEQ ID NO: 290 (IR-025), SEQ ID NO: 306 (IR-026), SEQ ID NO: 322 (IR-027), SEQ ID NO: 338 (IR-028), SEQ ID NO: 354 (IR-029), SEQ ID NO: 370 (IR-030), SEQ ID NO: 386 (IR-031), SEQ ID NO: 402 (IR-032), SEQ ID NO: 418 (IR-033), SEQ ID NO: 434 (IR-034), SEQ ID NO: 450 (IR-035), SEQ ID NO: 466 (IR-036), SEQ ID NO: 482 (IR-037), SEQ ID NO: 498 (IR-038), SEQ ID NO: 514 (IR-039), SEQ ID NO: 530 (IR-040), SEQ ID NO: 546 (IR-041), SEQ ID NO: 562 (IR-043), SEQ ID NO: 578 (IR-044), SEQ ID NO: 594 (IR-045), SEQ ID NO: 610 (IR-046), SEQ ID NO: 626 (IR-048), SEQ ID NO: 642 (IR-049), SEQ ID NO: 658 (IR-050), SEQ ID NO: 674 (IR-051), SEQ ID NO: 690 (IR-052), SEQ ID NO: 706 (IR-053), SEQ ID NO: 722 (IR-054), SEQ ID NO: 738 (IR-055), SEQ ID NO: 754 (IR-056), SEQ ID NO: 770 (IR-057), SEQ ID NO: 786 (IR-058), SEQ ID NO: 802 (IR-059), SEQ ID NO: 818 (IR-060), SEQ ID NO: 834 (IR-061), SEQ ID NO: 850 (IR-062), SEQ ID NO: 866 (IR-063), SEQ ID NO: 882 (IR-064), SEQ ID NO: 898 (IR-065), SEQ ID NO: 914 (IR-066), SEQ ID NO: 930 (IR-067), SEQ ID NO: 946 (IR-068), SEQ ID NO: 962 (IR-069), SEQ ID NO: 978 (IR-070), SEQ ID NO: 994 (IR-071), SEQ ID NO: 1010 (IR-072), SEQ ID NO: 1026 (IR-073), SEQ ID NO: 1042 (IR-074), SEQ ID NO: 1058 (IR-075), SEQ ID NO: 1074 (IR-076), SEQ ID NO: 1090 (IR-077), SEQ ID NO: 1106 (IR-078), SEQ ID NO: 1122 (IR-079), SEQ ID NO: 1138 (IR-080), SEQ ID NO: 1154 (IR-081), SEQ ID NO: 1170 (IR-082), SEQ ID NO: 1186 (IR-083), SEQ ID NO: 1202 (IR-084), SEQ ID NO: 1218 (IR-085), SEQ ID NO: 1234 (IR-086), SEQ ID NO: 1250 (IR-087), SEQ ID NO: 1266 (IR-088), SEQ ID NO: 1282 (IR-089), SEQ ID NO: 1298 (IR-090), SEQ ID NO: 1314 (IR-092), SEQ ID NO: 1330 (IR-093), SEQ ID NO: 1346 (IR-094), SEQ ID NO: 1362 (IR-095), SEQ ID NO: 1378 (IR-097), SEQ ID NO: 1394 (IR-098), SEQ ID NO: 1410 (IR-100), SEQ ID NO: 1426 (IR-101), SEQ ID NO: 1442 (IR-102), SEQ ID NO: 1458 (IR-104), SEQ ID NO: 1474 (IR-105), SEQ ID NO: 1490 (IR-106), SEQ ID NO: 1506 (IR-107), SEQ ID NO: 1522 (IR-108), SEQ ID NO: 1538 (IR-109), SEQ ID NO: 1554 (IR-110), SEQ ID NO: 1570 (IR-112), SEQ ID NO: 1586 (IR-114), SEQ ID NO: 1602 (IR-115), SEQ ID NO: 1618 (IR-116), SEQ ID NO: 1634 (IR-117), SEQ ID NO: 1650 (IR-118), SEQ ID NO: 1666 (IR-119), SEQ ID NO: 1682 (IR-120), SEQ ID NO: 1698 (IR-121), SEQ ID NO: 1714 (IR-122), SEQ ID NO: 1730 (IR-123), SEQ ID

NO: 1746 (IR-124), SEQ ID NO: 1762 (IR-125), SEQ ID NO: 1778 (IR-126), SEQ ID NO: 1794 (IR-127), SEQ ID NO: 1810 (IR-128), SEQ ID NO: 1826 (IR-129), SEQ ID NO: 1842 (IR-131), SEQ ID NO: 1858 (IR-132), SEQ ID NO: 1874 (IR-133), SEQ ID NO: 1890 (IR-134), SEQ ID NO: 1906 (IR-135), SEQ ID NO: 1922 (IR-136), SEQ ID NO: 1938 (IR-137), SEQ ID NO: 1954 (IR-138), SEQ ID NO: 1970 (IR-139), SEQ ID NO: 1986 (IR-140), SEQ ID NO: 2002 (IR-141), SEQ ID NO: 2018 (IR-142), SEQ ID NO: 2034 (IR-143), SEQ ID NO: 2050 (IR-144), SEQ ID NO: 2066 (IR-145), SEQ ID NO: 2082 (IR-146), SEQ ID NO: 2098 (IR-147), SEQ ID NO: 2114 (IR-149), SEQ ID NO: 2130 (IR-150), SEQ ID NO: 2146 (IR-151), SEQ ID NO: 2162 (IR-152), SEQ ID NO: 2178 (IR-153), SEQ ID NO: 2194 (IR-154), SEQ ID NO: 2210 (IR-155), SEQ ID NO: 2226 (IR-156), SEQ ID NO: 2242 (IR-157), SEQ ID NO: 2258 (IR-158), SEQ ID NO: 2274 (IR-159), SEQ ID NO: 2862 (IR-160), and SEQ ID NO: 2878 (IR-161).

Furthermore, the following nucleotide sequences of regions comprising VL CDR1, CDR2, and CDR3 were obtained:

SEQ ID NO: 3 (IR-001), SEQ ID NO: 19 (IR-002), SEQ ID NO: 35 (IR-004), SEQ ID NO: 51 (IR-005), SEQ ID NO: 67 (IR-006), SEQ ID NO: 83 (IR-007), SEQ ID NO: 99 (IR-008), SEQ ID NO: 115 (IR-011), SEQ ID NO: 131 (IR-012), SEQ ID NO: 147 (IR-013), SEQ ID NO: 163 (IR-014), SEQ ID NO: 179 (IR-015), SEQ ID NO: 195 (IR-017), SEQ ID NO: 211 (IR-020), SEQ ID NO: 227 (IR-021), SEQ ID NO: 243 (IR-022), SEQ ID NO: 259 (IR-023), SEQ ID NO: 275 (IR-024), SEQ ID NO: 291 (IR-025), SEQ ID NO: 307 (IR-026), SEQ ID NO: 323 (IR-027), SEQ ID NO: 339 (IR-028), SEQ ID NO: 355 (IR-029), SEQ ID NO: 371 (IR-030), SEQ ID NO: 387 (IR-031), SEQ ID NO: 403 (IR-032), SEQ ID NO: 419 (IR-033), SEQ ID NO: 435 (IR-034), SEQ ID NO: 451 (IR-035), SEQ ID NO: 467 (IR-036), SEQ ID NO: 483 (IR-037), SEQ ID NO: 499 (IR-038), SEQ ID NO: 515 (IR-039), SEQ ID NO: 531 (IR-040), SEQ ID NO: 547 (IR-041), SEQ ID NO: 563 (IR-043), SEQ ID NO: 579 (IR-044), SEQ ID NO: 595 (IR-045), SEQ ID NO: 611 (IR-046), SEQ ID NO: 627 (IR-048), SEQ ID NO: 643 (IR-049), SEQ ID NO: 659 (IR-050), SEQ ID NO: 675 (IR-051), SEQ ID NO: 691 (IR-052), SEQ ID NO: 707 (IR-053), SEQ ID NO: 723 (IR-054), SEQ ID NO: 739 (IR-055), SEQ ID NO: 755 (IR-056), SEQ ID NO: 771 (IR-057), SEQ ID NO: 787 (IR-058), SEQ ID NO: 803 (IR-059), SEQ ID NO: 819 (IR-060), SEQ ID NO: 835 (IR-061), SEQ ID NO: 851 (IR-062), SEQ ID NO: 867 (IR-063), SEQ ID NO: 883 (IR-064), SEQ ID NO: 899 (IR-065), SEQ ID NO: 915 (IR-066), SEQ ID NO: 931 (IR-067), SEQ ID NO: 947 (IR-068), SEQ ID NO: 963 (IR-069), SEQ ID NO: 979 (IR-070), SEQ ID NO: 995 (IR-071), SEQ ID NO: 1011 (IR-072), SEQ ID NO: 1027 (IR-073), SEQ ID NO: 1043 (IR-074), SEQ ID NO: 1059 (IR-075), SEQ ID NO: 1075 (IR-076), SEQ ID NO: 1091 (IR-077), SEQ ID NO: 1107 (IR-078), SEQ ID NO: 1123 (IR-079), SEQ ID NO: 1139 (IR-080), SEQ ID NO: 1155 (IR-081), SEQ ID NO: 1171 (IR-082), SEQ ID NO: 1187 (IR-083), SEQ ID NO: 1203 (IR-084), SEQ ID NO: 1219 (IR-085), SEQ ID NO: 1235 (IR-086), SEQ ID NO: 1251 (IR-087), SEQ ID NO: 1267 (IR-088), SEQ ID NO: 1283 (IR-089), SEQ ID NO: 1299 (IR-090), SEQ ID NO: 1315 (IR-092), SEQ ID NO: 1331 (IR-093), SEQ ID NO: 1347 (IR-094), SEQ ID NO: 1363 (IR-095), SEQ ID NO: 1379 (IR-097), SEQ ID NO: 1395 (IR-098), SEQ ID NO: 1411 (IR-100), SEQ ID NO: 1427 (IR-101), SEQ ID NO: 1443 (IR-102), SEQ ID NO: 1459 (IR-104), SEQ ID NO: 1475 (IR-105), SEQ ID NO: 1491 (IR-106), SEQ ID NO: 1507 (IR-107), SEQ ID NO: 1523 (IR-108), SEQ ID NO: 1539 (IR-109), SEQ ID NO: 1555 (IR-110), SEQ ID NO: 1571 (IR-112), SEQ ID NO: 1587 (IR-114), SEQ ID NO: 1603 (IR-115), SEQ ID NO: 1619 (IR-116), SEQ ID NO: 1635 (IR-117), SEQ ID NO: 1651 (IR-118), SEQ ID NO: 1667 (IR-119), SEQ ID NO: 1683 (IR-120), SEQ ID NO: 1699 (IR-121), SEQ ID NO: 1715 (IR-122), SEQ ID NO: 1731 (IR-123), SEQ ID NO: 1747 (IR-124), SEQ ID NO: 1763 (IR-125), SEQ ID NO: 1779 (IR-126), SEQ ID NO: 1795 (IR-127), SEQ ID NO: 1811 (IR-128), SEQ ID NO: 1827 (IR-129), SEQ ID NO: 1843 (IR-131), SEQ ID NO: 1859 (IR-132), SEQ ID NO: 1875 (IR-133), SEQ ID NO: 1891 (IR-134), SEQ ID NO: 1907 (IR-135), SEQ ID NO: 1923 (IR-136), SEQ ID NO: 1939 (IR-137), SEQ ID NO: 1955 (IR-138), SEQ ID NO: 1971 (IR-139), SEQ ID NO: 1987 (IR-140), SEQ ID NO: 2003 (IR-141), SEQ ID NO: 2019 (IR-142), SEQ ID NO: 2035 (IR-143), SEQ ID NO: 2051 (IR-144), SEQ ID NO: 2067 (IR-145), SEQ ID NO: 2083 (IR-146), SEQ ID NO: 2099 (IR-147), SEQ ID NO: 2115 (IR-149), SEQ ID NO: 2131 (IR-150), SEQ ID NO: 2147 (IR-151), SEQ ID NO: 2163 (IR-152), SEQ ID NO: 2179 (IR-153), SEQ ID NO: 2195 (IR-154), SEQ ID NO: 2211 (IR-155), SEQ ID NO: 2227 (IR-156), SEQ ID NO: 2243 (IR-157), SEQ ID NO: 2259 (IR-158), SEQ ID NO: 2275 (IR-159), SEQ ID NO: 2863 (IR-160), and SEQ ID NO: 2879 (IR-161). From the above nucleotide sequence, the following amino acid sequences were obtained:

SEQ ID NO: 4 (IR-001), SEQ ID NO: 20 (IR-002), SEQ ID NO: 36 (IR-004), SEQ ID NO: 52 (IR-005), SEQ ID NO: 68 (IR-006), SEQ ID NO: 84 (IR-007), SEQ ID NO: 100 (IR-008), SEQ ID NO: 116 (IR-011), SEQ ID NO: 132 (IR-012), SEQ ID NO: 148 (IR-013), SEQ ID NO: 164 (IR-014), SEQ ID NO: 180 (IR-015), SEQ ID NO: 196 (IR-017), SEQ ID NO: 212 (IR-020), SEQ ID NO: 228 (IR-021), SEQ ID NO: 244 (IR-022), SEQ ID NO: 260 (IR-023), SEQ ID NO: 276 (IR-024), SEQ ID NO: 292 (IR-025), SEQ ID NO: 308 (IR-026), SEQ ID NO: 324 (IR-027), SEQ ID NO: 340 (IR-028), SEQ ID NO: 356 (IR-029), SEQ ID NO: 372 (IR-030), SEQ ID NO: 388 (IR-031), SEQ ID NO: 404 (IR-032), SEQ ID NO: 420 (IR-033), SEQ ID NO: 436 (IR-034), SEQ ID NO: 452 (IR-035), SEQ ID NO: 468 (IR-036), SEQ ID NO: 484 (IR-037), SEQ ID NO: 500 (IR-038), SEQ ID NO: 516 (IR-039), SEQ ID NO: 532 (IR-040), SEQ ID NO: 548 (IR-041), SEQ ID NO: 564 (IR-043), SEQ ID NO: 580 (IR-044), SEQ ID NO: 596 (IR-045), SEQ ID NO: 612 (IR-046), SEQ ID NO: 628 (IR-048), SEQ ID NO: 644 (IR-049), SEQ ID NO: 660 (IR-050), SEQ ID NO: 676 (IR-051), SEQ ID NO: 692 (IR-052), SEQ ID NO: 708 (IR-053), SEQ ID NO: 724 (IR-054), SEQ ID NO: 740 (IR-055), SEQ ID NO: 756 (IR-056), SEQ ID NO: 772 (IR-057), SEQ ID NO: 788 (IR-058), SEQ ID NO: 804 (IR-059), SEQ ID NO: 820 (IR-060), SEQ ID NO: 836 (IR-061), SEQ ID NO: 852 (IR-062), SEQ ID NO: 868 (IR-063), SEQ ID NO: 884 (IR-064), SEQ ID NO: 900 (IR-065), SEQ ID NO: 916 (IR-066), SEQ ID NO: 932 (IR-067), SEQ ID NO: 948 (IR-068), SEQ ID NO: 964 (IR-069), SEQ ID NO: 980 (IR-070), SEQ ID NO: 996 (IR-071), SEQ ID NO: 1012 (IR-072), SEQ ID NO: 1028 (IR-073), SEQ ID NO: 1044 (IR-074), SEQ ID NO: 1060 (IR-075), SEQ ID NO: 1076 (IR-076), SEQ ID NO: 1092 (IR-077), SEQ ID NO: 1108 (IR-078), SEQ ID NO: 1124 (IR-079), SEQ ID NO: 1140 (IR-080), SEQ ID NO: 1156 (IR-081), SEQ ID NO: 1172 (IR-082), SEQ ID NO: 1188 (IR-083), SEQ ID NO: 1204 (IR-084), SEQ ID NO: 1220 (IR-085), SEQ ID NO: 1236 (IR-086), SEQ ID NO: 1252 (IR-087), SEQ ID NO: 1268 (IR-088), SEQ ID NO: 1284 (IR-089), SEQ ID NO: 1300 (IR-090), SEQ ID NO: 1316 (IR-092), SEQ ID NO: 1332 (IR-093), SEQ ID NO: 1348 (IR-094), SEQ ID NO: 1364 (IR-095), SEQ ID NO: 1380 (IR-097), SEQ ID

NO: 1396 (IR-098), SEQ ID NO: 1412 (IR-100), SEQ ID NO: 1428 (IR-101), SEQ ID NO: 1444 (IR-102), SEQ ID NO: 1460 (IR-104), SEQ ID NO: 1476 (IR-105), SEQ ID NO: 1492 (IR-106), SEQ ID NO: 1508 (IR-107), SEQ ID NO: 1524 (IR-108), SEQ ID NO: 1540 (IR-109), SEQ ID NO: 1556 (IR-110), SEQ ID NO: 1572 (IR-112), SEQ ID NO: 1588 (IR-114), SEQ ID NO: 1604 (IR-115), SEQ ID NO: 1620 (IR-116), SEQ ID NO: 1636 (IR-117), SEQ ID NO: 1652 (IR-118), SEQ ID NO: 1668 (IR-119), SEQ ID NO: 1684 (IR-120), SEQ ID NO: 1700 (IR-121), SEQ ID NO: 1716 (IR-122), SEQ ID NO: 1732 (IR-123), SEQ ID NO: 1748 (IR-124), SEQ ID NO: 1764 (IR-125), SEQ ID NO: 1780 (IR-126), SEQ ID NO: 1796 (IR-127), SEQ ID NO: 1812 (IR-128), SEQ ID NO: 1828 (IR-129), SEQ ID NO: 1844 (IR-131), SEQ ID NO: 1860 (IR-132), SEQ ID NO: 1876 (IR-133), SEQ ID NO: 1892 (IR-134), SEQ ID NO: 1908 (IR-135), SEQ ID NO: 1924 (IR-136), SEQ ID NO: 1940 (IR-137), SEQ ID NO: 1956 (IR-138), SEQ ID NO: 1972 (IR-139), SEQ ID NO: 1988 (IR-140), SEQ ID NO: 2004 (IR-141), SEQ ID NO: 2020 (IR-142), SEQ ID NO: 2036 (IR-143), SEQ ID NO: 2052 (IR-144), SEQ ID NO: 2068 (IR-145), SEQ ID NO: 2084 (IR-146), SEQ ID NO: 2100 (IR-147), SEQ ID NO: 2116 (IR-149), SEQ ID NO: 2132 (IR-150), SEQ ID NO: 2148 (IR-151), SEQ ID NO: 2164 (IR-152), SEQ ID NO: 2180 (IR-153), SEQ ID NO: 2196 (IR-154), SEQ ID NO: 2212 (IR-155), SEQ ID NO: 2228 (IR-156), SEQ ID NO: 2244 (IR-157), SEQ ID NO: 2260 (IR-158), SEQ ID NO: 2276 (IR-159), SEQ ID NO: 2864 (IR-160), and SEQ ID NO: 2880 (IR-161).

CDR sequences were determined from the amino acid sequences, based on the definition by Kabat (Kabat, Elvin A., Sequences of proteins of immunological interest 5th ed., National Institutes of Health, 1991). The CDR sequences of the antibodies are shown in Table 1. In Table 1, "Name" shows the name of each antibody, "class" shows the IgG subclass of each antibody, "chain" shows whether the chain is an H or L chain, and "(na)" means "nucleic acid".

TABLE 1

| Name | class | chain | CDR1 | SEQ ID NO | SEQ ID NO (na) | CDR2 | SEQ ID NO | SEQ ID NO (na) |
|---|---|---|---|---|---|---|---|---|
| IR-001 | 2b | H | SYGVH | 6 | 5 | VIWSGGSTDYNAAFIS | 8 | 7 |
|  |  | L | KSSQSLLNSRTRKNYLA | 12 | 11 | WASTRES | 14 | 13 |
| IR-002 | 1 | H | SYGMS | 22 | 21 | TISSGGSYTYYPDSVKG | 24 | 23 |
|  |  | L | RSSQSIVHSNGNTYLE | 28 | 27 | KVSNRFS | 30 | 29 |
| IR-004 | 2b | H | TSGMGVS | 38 | 37 | HIYWDDDKRYNPSLKS | 40 | 39 |
|  |  | L | RSSQSLVHSNGNTYLH | 44 | 43 | KVSNRFS | 46 | 45 |
| IR-005 | 2b | H | TSGMGVS | 54 | 53 | HIYWDDDKRYNPSLKS | 56 | 55 |
|  |  | L | RSSQSIVHSNGNTYLE | 60 | 59 | KVSNRFS | 62 | 61 |
| IR-006 | 2b | H | TSGMGVS | 70 | 69 | HIYWDDDKRYNPSLKS | 72 | 71 |
|  |  | L | KSSQSLLNSRTRKNYLA | 76 | 75 | WASTRES | 78 | 77 |
| IR-007 | 2a | H | TSGMGVS | 86 | 85 | HIYWDDDKRYNPSLKS | 88 | 87 |
|  |  | L | RSSQSIVHSNGNTYLE | 92 | 91 | KVSNRFS | 94 | 93 |
| IR-008 | 2a | H | TSGMGVG | 102 | 101 | HIWWDDDKYYNPSLKS | 104 | 103 |
|  |  | L | KSSQSLLNSRTRKNYLA | 108 | 107 | WASTRES | 110 | 109 |
| IR-011 | 2b | H | SFGMH | 118 | 117 | YISSGSSTIYYADTVKG | 120 | 119 |
|  |  | L | KSSQSLLNSRTRKNYLA | 124 | 123 | WASTRES | 126 | 125 |
| IR-012 | 2a | H | TSGMGVG | 134 | 133 | HIWWDDDKYYNPSLKS | 136 | 135 |
|  |  | L | KSSQSLLNSRTRKNYLA | 140 | 139 | WASTRES | 142 | 141 |
| IR-013 | 2b | H | TSGMGVG | 150 | 149 | HIWWDDDKYYNPSLKS | 152 | 151 |
|  |  | L | KSSQSLLNSRTRKNYLA | 156 | 155 | WASTRES | 158 | 157 |
| IR-014 | 2a | H | TSGMGVG | 166 | 165 | HIWWDDDKYYNPSLKS | 168 | 167 |
|  |  | L | RSSQGIVHSTGNTYLE | 172 | 171 | KVSNRFS | 174 | 173 |
| IR-015 | 2a | H | TSGMGVG | 182 | 181 | HIWWDDDKYYNPSLKS | 184 | 183 |
|  |  | L | RSSQSIVHSNGNTYLE | 188 | 187 | KVSNRFS | 190 | 189 |
| IR-017 | 2a | H | TSGMGVS | 198 | 197 | HIYWDDDKRYNPSLKS | 200 | 199 |
|  |  | L | RSSQSIVHSNGNTYLE | 204 | 203 | KVSNRFS | 206 | 205 |
| IR-020 | 2b | H | TSGMGVS | 214 | 213 | HIYWDDDKRYNPSLKS | 216 | 215 |
|  |  | L | RSSQSIVHSNGNTYLE | 220 | 219 | KVSNRFS | 222 | 221 |
| IR-021 | 2b | H | TSGMGVG | 230 | 229 | HIWWDDDKYYNPSLKS | 232 | 231 |
|  |  | L | RSSQSIVHSNGNTYLE | 236 | 235 | KVSNRFS | 238 | 237 |
| IR-022 | 2a | H | TSGMGVG | 246 | 245 | HIWWDDDKYYNPSLKS | 248 | 247 |
|  |  | L | RSSQSIVHSNGNTYLE | 252 | 251 | KVSNRFS | 254 | 253 |
| IR-023 | 2b | H | TSGMGVS | 262 | 261 | HIYWDDDKRYNPSLKS | 264 | 263 |
|  |  | L | RSSQSIVHSNGNTYLE | 268 | 267 | KVSNRFS | 270 | 269 |
| IR-024 | 2a | H | SYAMS | 278 | 277 | TISSGGSYTYYPDSVKG | 280 | 279 |
|  |  | L | KSSQSLLNSRTRKNYLA | 284 | 283 | WASTRES | 286 | 285 |
| IR-025 | 2a | H | TSGMGVG | 294 | 293 | HIWWDDDKYYNPSLKS | 296 | 295 |
|  |  | L | RSSQSIVHSNGNTYLE | 300 | 299 | KVSNRFS | 302 | 301 |
| IR-026 | 2b | H | SFGMH | 310 | 309 | YISSGSSTIYYADTVKG | 312 | 311 |
|  |  | L | RSSQSIVHSNGNTYLE | 316 | 315 | KVSNRFS | 318 | 317 |
| IR-027 | 2b | H | SFGMH | 326 | 325 | YISSGSSTIYYADTVKG | 328 | 327 |
|  |  | L | RSSQSIVHSNGNTYLE | 332 | 331 | KVSNRFS | 334 | 333 |
| IR-028 | 2b | H | SFGMH | 342 | 341 | YISSGSSTIYYADTVKG | 344 | 343 |
|  |  | L | RSSQSLVHSNGNTYLH | 348 | 347 | KVSNRFS | 350 | 349 |
| IR-029 | 2b | H | TSGMGVS | 358 | 357 | HIYWDDDKRYNPSLKS | 360 | 359 |
|  |  | L | RSSQSIVHSNGNTYLE | 364 | 363 | KVSNRFS | 366 | 365 |
| IR-030 | 1 | H | SFGMH | 374 | 373 | YISSGSSTIYYADTVKG | 376 | 375 |
|  |  | L | RSSQSIVHSNGNTYLE | 380 | 379 | KVSNRFS | 382 | 381 |
| IR-031 | 2a | H | TSGMGVS | 390 | 389 | HIYWDDDKRYNPSLKS | 392 | 391 |
|  |  | L | RSSQSIVHSNGNTYLE | 396 | 395 | KVSNRFS | 398 | 397 |
| IR-032 | 2b | H | TSGMGVG | 406 | 405 | HIWWDDVKRYNPALKS | 408 | 407 |
|  |  | L | RSSQSLVHSNGNTYLH | 412 | 411 | KVSNRSS | 414 | 413 |

TABLE 1-continued

| | | | | | | | | |
|---|---|---|---|---|---|---|---|---|
| IR-033 | 2b | H | SYWIE | 422 | 421 | DILPGIGTTNYNEKFKG | 424 | 423 |
| | | L | KSSQSLLYSNGKTYLN | 428 | 427 | LVSKLDS | 430 | 429 |
| IR-034 | 2b | H | TSGMGVG | 438 | 437 | HIWWDDVKRYNPALKS | 440 | 439 |
| | | L | RSSQSLVHSNGNTYLH | 444 | 443 | KVSNRFS | 446 | 445 |
| IR-035 | 2b | H | TSGMGVS | 454 | 453 | HIYWDDDKRYNPSLKS | 456 | 455 |
| | | L | RSSQSIVHSNGNTYLE | 460 | 459 | KVSNRFS | 462 | 461 |
| IR-036 | 2b | H | TSGMGVS | 470 | 469 | HIYWDDDKRYNPSLKS | 472 | 471 |
| | | L | RSSQSIVHSNGNTYLE | 476 | 475 | KVSNRFS | 478 | 477 |
| IR-037 | 1 | H | SFGMH | 486 | 485 | YISSGSSTIYYADTVKG | 488 | 487 |
| | | L | RSSQSLENSNGNTYLN | 492 | 491 | RVSNRFS | 494 | 493 |
| IR-038 | 2b | H | TSGMGVS | 502 | 501 | HIYWDDDKRYNPSLKS | 504 | 503 |
| | | L | RSSQSIVHSNGNTYLE | 508 | 507 | KVSNRFS | 510 | 509 |
| IR-039 | 2b | H | TSGMGVS | 518 | 517 | HIYWDDDKRYNPSLKS | 520 | 519 |
| | | L | RSSQSIVHSNGNTYLE | 524 | 523 | KVSNRFS | 526 | 525 |
| IR-040 | 2a | H | TSGMGVG | 534 | 533 | HIWWDDVKRYNPALKS | 536 | 535 |
| | | L | RSSQSLVHSNGNTYLH | 540 | 539 | KVSNRFS | 542 | 541 |
| IR-041 | 2a | H | TSGMGVS | 550 | 549 | HIYWDDDKRYNPSLKS | 552 | 551 |
| | | L | RSSQSIVHSNGNTYLE | 556 | 555 | KVSNRFS | 558 | 557 |
| IR-043 | 2a | H | TSGMGVS | 566 | 565 | HIYWDDDKRYNPSLKS | 568 | 567 |
| | | L | RSSQSIVHSNGNTYLE | 572 | 571 | KVSNRFS | 574 | 573 |
| IR-044 | 1 | H | TSGMGVG | 582 | 581 | HIWWDDDKYYNPSLKS | 584 | 583 |
| | | L | RSSQSIVHSNGNTYLE | 588 | 587 | KVSNRFS | 590 | 589 |
| IR-045 | 2b | H | SGYSWH | 598 | 597 | YIHYSGSTNYNPSLKS | 600 | 599 |
| | | L | RSSQSLVHSNGNTYLH | 604 | 603 | KVSNRFS | 606 | 605 |
| IR-046 | 2a | H | TSGMGVS | 614 | 613 | HIYWDDDKRYNPSLKS | 616 | 615 |
| | | L | RSSQSIVHSNGNTYLE | 620 | 619 | KVSNRFS | 622 | 621 |
| IR-048 | 2a | H | TSGMGVG | 630 | 629 | HIWWDDDKYYNPSLKS | 632 | 631 |
| | | L | RSSQSIVHSNGNTYLE | 636 | 635 | KVSNRFS | 638 | 637 |
| IR-049 | 1 | H | TSGMGVS | 646 | 645 | HIYWDDDKRYNPSLKS | 648 | 647 |
| | | L | RSSQSIVHSNGNTYLE | 652 | 651 | KVSNRFS | 654 | 653 |
| IR-050 | 2a | H | SFGMH | 662 | 661 | YISSGSSTIYYADTVKG | 664 | 663 |
| | | L | RSSQSIVHSNGNTYLE | 668 | 667 | KVSNRFS | 670 | 669 |
| IR-051 | 2b | H | TSGMGVS | 678 | 677 | HIYWDDDKHYNPSLKS | 680 | 679 |
| | | L | RSSQSIVHSNGNTYLE | 684 | 683 | KVSNRFS | 686 | 685 |
| IR-052 | 2a | H | TSGMGVG | 694 | 693 | HIWWDDDKYYNPSLKS | 696 | 695 |
| | | L | RSSQSIVHSNGNTYLE | 700 | 699 | KVSNRFS | 702 | 701 |
| IR-053 | 1 | H | SFGMH | 710 | 709 | YISSGSSTIYYADTVKG | 712 | 711 |
| | | L | RSSQSIVHSNGNTYLE | 716 | 715 | KVSNRFS | 718 | 717 |
| IR-054 | 1 | H | SFGMH | 726 | 725 | YISSGSSTIYYADTVKG | 728 | 727 |
| | | L | RSSQSLVHSNGNTYLH | 732 | 731 | KVSNRFS | 734 | 733 |
| IR-055 | 1 | H | TSGMGVS | 742 | 741 | HIYWDDDKRYNPSLKS | 744 | 743 |
| | | L | RSSQSIVHSNGNTYLE | 748 | 747 | KVSNRFS | 750 | 749 |
| IR-056 | 2b | H | SFGMH | 758 | 757 | YISSGSSTIYYADTVKG | 760 | 759 |
| | | L | RSSQSIVHSNGNTYLE | 764 | 763 | KVSNRFS | 766 | 765 |
| IR-057 | 1 | H | SFGMH | 774 | 773 | YISSGSSTIYYADTVKG | 776 | 775 |
| | | L | RSSQSIVHSNGNTYLE | 780 | 779 | KVSNRFS | 782 | 781 |
| IR-058 | 1 | H | SFGMH | 790 | 789 | YISSGSSTIYYADTVKG | 792 | 791 |
| | | L | RSSQSLVHSNGNTYLH | 796 | 795 | KVSNRFS | 798 | 797 |
| IR-059 | 2b | H | TSGMGVS | 806 | 805 | HIYWDDDKAYNPSLKS | 808 | 807 |
| | | L | RSSQSIVHSNGNTYLE | 812 | 811 | KVSNRFS | 814 | 813 |
| IR-060 | 2a | H | SFGMH | 822 | 821 | YISSGSSTIYYADTVKG | 824 | 823 |
| | | L | RSSQSIVHSNGNTYLE | 828 | 827 | KVSNRFS | 830 | 829 |
| IR-061 | 2b | H | SFGMH | 838 | 837 | YISSGSSTIYYADTVKG | 840 | 839 |
| | | L | RSSQSIVHSNGNTYLE | 844 | 843 | KVSNRFS | 846 | 845 |
| IR-062 | 2b | H | SFGMH | 854 | 853 | YISSGSSTIYYADTVKG | 856 | 855 |
| | | L | RSSQSIVHSNGNTYLE | 860 | 859 | KVSNRFS | 862 | 861 |
| IR-063 | 2b | H | SFGMH | 870 | 869 | YISSGSSTIYYADTVKG | 872 | 871 |
| | | L | RSSQSLVHSNGNTYLH | 876 | 875 | KVSNRFS | 878 | 877 |
| IR-064 | 2b | H | TSGMGVS | 886 | 885 | HIYWDDDKRYNPSLKS | 888 | 887 |
| | | L | RSSQSIVHSNGNTYLE | 892 | 891 | KVSNRFS | 894 | 893 |
| IR-065 | 2b | H | SFGMH | 902 | 901 | YISSGSSTIYYADTVKG | 904 | 903 |
| | | L | RSSQSIVHSNGNTYLE | 908 | 907 | KVSNRFS | 910 | 909 |
| IR-066 | 2b | H | SYGVH | 918 | 917 | VIWSGGSTDYNAAFIS | 920 | 919 |
| | | L | RSSQSIVHSNGNTYLE | 924 | 923 | KVSNRFS | 926 | 925 |
| IR-067 | 2b | H | SFGMH | 934 | 933 | YISSGSSTIYYADTVKG | 936 | 935 |
| | | L | RSSQSIVHSNGNTYLE | 940 | 939 | KVSNRFS | 942 | 941 |
| IR-068 | 1 | H | SFGMH | 950 | 949 | YISSGSSTIYYADTVKG | 952 | 951 |
| | | L | RSSQSIVHSNGNTYLE | 956 | 955 | KVSNRFS | 958 | 957 |
| IR-069 | 2b | H | SFGMH | 966 | 965 | YISSGSSTIYYADTVKG | 968 | 967 |
| | | L | RSSQSIVHSNGNTYLE | 972 | 971 | KVSNRFS | 974 | 973 |
| IR-070 | 2b | H | SFGMH | 982 | 981 | YISSGSSTIYYADTVKG | 984 | 983 |
| | | L | RSSQSLVHSNGNTYLH | 988 | 987 | KVSNRFS | 990 | 989 |
| IR-071 | 2b | H | SFGMH | 998 | 997 | YISSGSSTIYYVDTVKG | 1000 | 999 |
| | | L | RSSQSIVHSNGNTYLE | 1004 | 1003 | KVSNRFS | 1006 | 1005 |
| IR-072 | 1 | H | TSGMGVS | 1014 | 1013 | HIYWDDDKRYNPSLKS | 1016 | 1015 |
| | | L | RSSQSIVHSNGNTYLE | 1020 | 1019 | KVSNRFS | 1022 | 1021 |
| IR-073 | 2b | H | SFGMH | 1030 | 1029 | YISSGSSTIYYADTVKG | 1032 | 1031 |
| | | L | RSSQSIVHSNGNTYLE | 1036 | 1035 | KVSNRFS | 1038 | 1037 |
| IR-074 | 2a | H | TSGMGVS | 1046 | 1045 | HIYWDDDKRYNPSLKS | 1048 | 1047 |
| | | L | RSSQSLVHSNGNTYLH | 1052 | 1051 | KVSNRFS | 1054 | 1053 |

TABLE 1-continued

| | | | | | | | | |
|---|---|---|---|---|---|---|---|---|
| IR-075 | 2b | H | SFGMH | 1062 | 1061 | YISSGSSTIYYADTVKG | 1064 | 1063 |
| | | L | RSSQSLVHSNGNTYLH | 1068 | 1067 | KVSNRFS | 1070 | 1069 |
| IR-076 | 2b | H | SFGMH | 1078 | 1077 | YISSGSSTIYYADTVKG | 1080 | 1079 |
| | | L | RSSQSIVHSNGNTYLH | 1084 | 1083 | KVSNRFS | 1086 | 1085 |
| IR-077 | 2a | H | SFGMH | 1094 | 1093 | YISSGSSTIYYADTVKG | 1096 | 1095 |
| | | L | RSSQSIVHSNGNTYLE | 1100 | 1099 | KVSNRFS | 1102 | 1101 |
| IR-078 | 2b | H | SYWMH | 1110 | 1109 | YINPSTGYTEYNQKFKD | 1112 | 1111 |
| | | L | RSSQSLVHSNGNTYLH | 1116 | 1115 | KVSNRFS | 1118 | 1117 |
| IR-079 | 2b | H | SFGMH | 1126 | 1125 | YISSGSSTIYYADTVKG | 1128 | 1127 |
| | | L | RSSQSIVHSNGNTYLE | 1132 | 1131 | KVSNRFS | 1134 | 1133 |
| IR-080 | 2a | H | TSGMGVS | 1142 | 1141 | HIYWDDDKRYNPSLKS | 1144 | 1143 |
| | | L | RSSQSIVHSNGNTYLE | 1148 | 1147 | KVSNRFS | 1150 | 1149 |
| IR-081 | 2b | H | SFGMH | 1158 | 1157 | YISSGSSTIYYADTVKG | 1160 | 1159 |
| | | L | RSSQSIVHSNGNTYLE | 1164 | 1163 | KVSNRFS | 1166 | 1165 |
| IR-082 | 2b | H | SFGMH | 1174 | 1173 | YISSGSSTIYYADTVKG | 1176 | 1175 |
| | | L | RSSQSLENSNGNTYLN | 1180 | 1179 | RVSNRFS | 1182 | 1181 |
| IR-083 | 2b | H | RFGMY | 1190 | 1189 | YISSGSSTIYYADIVKG | 1192 | 1191 |
| | | L | RSSQSIVHSNGNTYLE | 1196 | 1195 | KVSNRFS | 1198 | 1197 |
| IR-084 | 2b | H | SFGMH | 1206 | 1205 | YISSGSSTIYYADTVKG | 1208 | 1207 |
| | | L | RSSQSIVHSNGNTYLE | 1212 | 1211 | KVSNRFS | 1214 | 1213 |
| IR-085 | 2b | H | SFGMH | 1222 | 1221 | YISSGSSTFYYADTVKG | 1224 | 1223 |
| | | L | RSSQSIVHSNGNTYLE | 1228 | 1227 | KVSNRFS | 1230 | 1229 |
| IR-086 | 2a | H | SFGMH | 1238 | 1237 | YISSGSSTIYYADTVKG | 1240 | 1239 |
| | | L | RSSQSIVHSNGNTYLE | 1244 | 1243 | KVSNRFS | 1246 | 1245 |
| IR-087 | 2b | H | TSGMSVG | 1254 | 1253 | HIWWDDDKRYNPALKS | 1256 | 1255 |
| | | L | RSSQSIVHSNGNTYLE | 1260 | 1259 | KVSNRFS | 1262 | 1261 |
| IR-088 | 1 | H | DTYIH | 1270 | 1269 | RIDPANGNTKYDPKFQG | 1272 | 1271 |
| | | L | KSSQSLLNSGNQKNYLT | 1276 | 1275 | WASTRES | 1278 | 1277 |
| IR-089 | 2a | H | SFGMH | 1286 | 1285 | YISSGSSTIYYADTVKG | 1288 | 1287 |
| | | L | RSSQSLVHSNGNTYLH | 1292 | 1291 | KVSNRFS | 1294 | 1293 |
| IR-090 | 2b | H | SFGMH | 1302 | 1301 | YISSGSSTIYYADTVKG | 1304 | 1303 |
| | | L | RSSQSIVHSNGNTYLE | 1308 | 1307 | KVSNRFS | 1310 | 1309 |
| IR-092 | 2a | H | TSGMGVS | 1318 | 1317 | HIYWDDDKRYNPSLKS | 1320 | 1319 |
| | | L | RSSQSIVHSNGNTYLE | 1324 | 1323 | KVSNRFS | 1326 | 1325 |
| IR-093 | 2a | H | SFGMH | 1334 | 1333 | YISSGSSTIYYADTVKG | 1336 | 1335 |
| | | L | RSSQSLVHSNGNTYLH | 1340 | 1339 | KVSNRFS | 1342 | 1341 |
| IR-094 | 2b | H | NYWMN | 1350 | 1349 | EIRLKSNNYATHYAESVKG | 1352 | 1351 |
| | | L | KSSQSLLYSSNQKNYLA | 1356 | 1355 | WASTRES | 1358 | 1357 |
| IR-095 | 2b | H | TSGMGVS | 1366 | 1365 | HIYWDDDKRYNPSLKS | 1368 | 1367 |
| | | L | RSSQSIVHSNGNTYLE | 1372 | 1371 | KVSNRFS | 1374 | 1373 |
| IR-097 | 2b | H | TSGMGVS | 1382 | 1381 | HIYWDDDKRYNPSLKS | 1384 | 1383 |
| | | L | RSSQSIVHSNGNTYLE | 1388 | 1387 | KVSNRFS | 1390 | 1389 |
| IR-098 | 2b | H | TSGMGVS | 1398 | 1397 | HIYWDDDKRYNPSLKS | 1400 | 1399 |
| | | L | RSSQSIVHSNGNTYLE | 1404 | 1403 | KVSNRFS | 1406 | 1405 |
| IR-100 | 2b | H | SFGMH | 1414 | 1413 | YISSGSSTIYYADTVKG | 1416 | 1415 |
| | | L | RSSQSLVHSNGNTYLH | 1420 | 1419 | KVSNRFS | 1422 | 1421 |
| IR-101 | 2b | H | SFGMH | 1430 | 1429 | YISSGSSTIYYADTVKG | 1432 | 1431 |
| | | L | RSSQSLEHSNGNTYLN | 1436 | 1435 | RVSNRFS | 1438 | 1437 |
| IR-102 | 1 | H | TSGMGVS | 1446 | 1445 | HIYWDDDKRYNPSLKS | 1448 | 1447 |
| | | L | RSSQSIVHSNGNTYLE | 1452 | 1451 | KVSNRFS | 1454 | 1453 |
| IR-104 | 2b | H | TSGMGVS | 1462 | 1461 | HIYWDDDKRYNPSLKS | 1464 | 1463 |
| | | L | RSSQSIVHSNGNTYLE | 1468 | 1467 | KVSNRFS | 1470 | 1469 |
| IR-105 | 2b | H | SYWMH | 1478 | 1477 | EINPSNGRTNYNEKFKS | 1480 | 1479 |
| | | L | RSSQSIVHSNGNTYLE | 1484 | 1483 | KVSNRFS | 1486 | 1485 |
| IR-106 | 2b | H | TSGMGVS | 1494 | 1493 | HIYWDDDKRYNPSLKS | 1496 | 1495 |
| | | L | RSSQSIVHSNGNTYLE | 1500 | 1499 | KVSNRFS | 1502 | 1501 |
| IR-107 | 2b | H | SFGMH | 1510 | 1509 | YISSGSSTIYYADTVKG | 1512 | 1511 |
| | | L | RSSQSIVHSNGNTYLE | 1516 | 1515 | KVSNRFS | 1518 | 1517 |
| IR-108 | 2a | H | TSGMGVG | 1526 | 1525 | HIWWDDDKYYNPSLKS | 1528 | 1527 |
| | | L | RSSQSIVHSNGNTYLE | 1532 | 1531 | KVSNRFS | 1534 | 1533 |
| IR-109 | 2a | H | TSGMGVS | 1542 | 1541 | HIYWDDDKRYNPSLKS | 1544 | 1543 |
| | | L | RSSQSIVHSNGNTYLE | 1548 | 1547 | KVSNRFS | 1550 | 1549 |
| IR-110 | 2b | H | SFGMH | 1558 | 1557 | YISSGSSTIYYADTVKG | 1560 | 1559 |
| | | L | RSSQSIVHSNGNTYLE | 1564 | 1563 | KVSNRFS | 1566 | 1565 |
| IR-112 | 2a | H | TSGMGVG | 1574 | 1573 | HIWWDDDKYYNPSLKS | 1576 | 1575 |
| | | L | RSSQSIVHSNGNTYLE | 1580 | 1579 | KVSNRFS | 1582 | 1581 |
| IR-114 | 2a | H | SFGMH | 1590 | 1589 | YISSGSSTIYYADTVKG | 1592 | 1591 |
| | | L | RSSQSIVHSNGNTYLE | 1596 | 1595 | KVSNRFS | 1598 | 1597 |
| IR-115 | 2b | H | SFGMH | 1606 | 1605 | YISSGSSTIYYADTVKG | 1608 | 1607 |
| | | L | RSSQSLVHSNGNTYLH | 1612 | 1611 | KVSNRFS | 1614 | 1613 |
| IR-116 | 2b | H | TSGMGVS | 1622 | 1621 | HIYWDDDKRYNPSLKS | 1624 | 1623 |
| | | L | RSSQSLVHSNGNTYLH | 1628 | 1627 | KVSNRFS | 1630 | 1629 |
| IR-117 | 2b | H | TSGMGVS | 1638 | 1637 | HIYWDDDKRYHPSLKS | 1640 | 1639 |
| | | L | RSSQSLVHSNGNTYLH | 1644 | 1643 | KVSNRFS | 1646 | 1645 |
| IR-118 | 2a | H | SYGVH | 1654 | 1653 | VIWSDGSTTYNSALKS | 1656 | 1655 |
| | | L | RSSQSLVHSNGNTYLH | 1660 | 1659 | KVSNRFS | 1662 | 1661 |
| IR-119 | 2b | H | SFGMH | 1670 | 1669 | YISSGSSTIYYADTVKG | 1672 | 1671 |
| | | L | RSSQSLVHSNGNTYLH | 1676 | 1675 | KVSNRFS | 1678 | 1677 |
| IR-120 | 2b | H | TSGMGVS | 1686 | 1685 | HIYWDYDKRYNPSLKS | 1688 | 1687 |
| | | L | RSSQSIVHSNGNTYLE | 1692 | 1691 | KVSNRFS | 1694 | 1693 |

TABLE 1-continued

| | | | | | | | | |
|---|---|---|---|---|---|---|---|---|
| IR-121 | 2b | H | SFGMH | 1702 | 1701 | YISSGSSTIYYADTVKG | 1704 | 1703 |
| | | L | RSSQSIVHSNGNTYLE | 1708 | 1707 | KVSNRFS | 1710 | 1703 |
| IR-122 | 2b | H | SFGMH | 1718 | 1717 | YISSGSSTIYYADTVKG | 1720 | 1719 |
| | | L | RSSQSIVHSNGNTYLE | 1724 | 1723 | KVSNRFS | 1726 | 1725 |
| IR-123 | 2a | H | SFGMH | 1734 | 1733 | YISSGSSTIYYADTVKG | 1736 | 1735 |
| | | L | RSSQSIVHSNGNTYLE | 1740 | 1739 | KVSNRFS | 1742 | 1741 |
| IR-124 | 2a | H | SFGMH | 1750 | 1749 | YISSGSSTIYYADTVKG | 1752 | 1751 |
| | | L | RSSQSIVHSNGNTYLE | 1756 | 1755 | KVSNRFS | 1758 | 1757 |
| IR-125 | 2b | H | SFGMH | 1766 | 1765 | YISSGSSTIYYADTVKG | 1768 | 1767 |
| | | L | RSSQSIVHSNGNTYLE | 1772 | 1771 | KVSNRFS | 1774 | 1773 |
| IR-126 | 2a | H | TSGMGVS | 1782 | 1781 | HIYWDDDKRYNPSLKS | 1784 | 1783 |
| | | L | RSSQSLVHSNGNTYLH | 1788 | 1787 | KVSNRFS | 1790 | 1789 |
| IR-127 | 2a | H | SFGMH | 1798 | 1797 | YISSGSSTIYYADTVKG | 1800 | 1799 |
| | | L | RSSQSIVHSNGNTYLE | 1804 | 1803 | KVSNRFS | 1806 | 1805 |
| IR-128 | 2a | H | SFGMH | 1814 | 1813 | YISSGSSTIYYADTVKG | 1816 | 1815 |
| | | L | RSSQSLVHSNGNTYLH | 1820 | 1819 | KVSNRFS | 1822 | 1821 |
| IR-129 | 2b | H | SFGMH | 1830 | 1829 | YISSGSTTIYYADTVKG | 1832 | 1831 |
| | | L | RSSQSIVHSNGNTYLE | 1836 | 1835 | KVSNRFS | 1838 | 1837 |
| IR-131 | 2a | H | DYYMY | 1846 | 1845 | YISNGGGSTYYPDTVKG | 1848 | 1847 |
| | | L | RSSQRLVHSNGNTYLH | 1852 | 1851 | KVSNRFS | 1854 | 1853 |
| IR-132 | 2b | H | SFGMH | 1862 | 1861 | YISSGSSTIYYADTVKG | 1864 | 1863 |
| | | L | RSSQSLVHSNGNTYLH | 1868 | 1867 | KVSNRFS | 1870 | 1869 |
| IR-133 | 2b | H | TSGMGVS | 1878 | 1877 | HIYWDDDKRYNPSLKS | 1880 | 1879 |
| | | L | RSSQSIVHSNGNTYLE | 1884 | 1883 | KVSNRFS | 1886 | 1885 |
| IR-134 | 2a | H | NYWMN | 1894 | 1893 | EIRLKSNNYATHYAESVKG | 1896 | 1895 |
| | | L | KSSQSLLNSGNQKNYLT | 1900 | 1899 | WASTRES | 1902 | 1901 |
| IR-135 | 2a | H | SYWMH | 1910 | 1909 | YINPSTGYTEYNQKFKD | 1912 | 1911 |
| | | L | RSSQSLVHSNGNTYLH | 1916 | 1915 | KVSNRFS | 1918 | 1917 |
| IR-136 | 2a | H | SFGMH | 1926 | 1925 | YISSGSSTIYYADTVKG | 1928 | 1927 |
| | | L | RSSQSIVHSNGNTYLE | 1932 | 1931 | KVSNRFS | 1934 | 1933 |
| IR-137 | 2a | H | SFGMH | 1942 | 1941 | YISSGSSTIYYADTVKG | 1944 | 1943 |
| | | L | RSSQSLVHSNGNTYLH | 1948 | 1947 | KVSNRFS | 1950 | 1949 |
| IR-138 | 2b | H | SFGMH | 1958 | 1957 | YISSGSSTIYYADTVKG | 1960 | 1959 |
| | | L | RSSQSIVHSNGNTYLE | 1964 | 1963 | KVSNRFS | 1966 | 1965 |
| IR-139 | 2b | H | SFGMH | 1974 | 1973 | YISSGSSTIYYADTVKG | 1976 | 1975 |
| | | L | RSSQSLVHSNGNTYLH | 1980 | 1979 | KVSNRFS | 1982 | 1981 |
| IR-140 | 2b | H | SFGMH | 1990 | 1989 | YISSGSSTIYYADTVKG | 1992 | 1991 |
| | | L | RSSQSIVHSNGNTYLE | 1996 | 1995 | KVSNRFS | 1998 | 1997 |
| IR-141 | 2b | H | TSGMGVS | 2006 | 2005 | HIYWDDDKRYNPSLKS | 2008 | 2007 |
| | | L | RSSQSLVHSNGNTYLH | 2012 | 2011 | KVSNRFS | 2014 | 2013 |
| IR-142 | 2a | H | TSGMGVS | 2022 | 2021 | HIYWDDDKRYNPSLKS | 2024 | 2023 |
| | | L | RSSQSIVHSNGNTYLE | 2028 | 2027 | KVSNRFS | 2030 | 2029 |
| IR-143 | 2b | H | SFGMH | 2038 | 2037 | YISSGSSTIYYADTVKG | 2040 | 2039 |
| | | L | RSSQSLVHSNGNTYLH | 2044 | 2043 | KVSNRFS | 2046 | 2045 |
| IR-144 | 2a | H | SYYMY | 2054 | 2053 | GINPSNGGTNFNEKFKS | 2056 | 2055 |
| | | L | RSSQSIVHSNGNTYLE | 2060 | 2059 | KVSNRFS | 2062 | 2061 |
| IR-145 | 2b | H | SFGMH | 2070 | 2069 | YISSGSSTIYYADTVKG | 2072 | 2071 |
| | | L | RSSQSIVHSNGNTYLE | 2076 | 2075 | KVSNRFS | 2078 | 2077 |
| IR-146 | 2a | H | SFGMH | 2086 | 2085 | YISSGSSTIYYADTVKG | 2088 | 2087 |
| | | L | RSSQSIVHSNGNTYLE | 2092 | 2091 | KVSNRFS | 2094 | 2093 |
| IR-147 | 2b | H | TSGMGVS | 2102 | 2101 | HIYWDDDKRYNPSLKS | 2104 | 2103 |
| | | L | RSSQSIVHSNGNTYLE | 2108 | 2107 | KVSNRFS | 2110 | 2109 |
| IR-149 | 2a | H | TSGMGVS | 2118 | 2117 | HIYWDDDKRYNPSLKS | 2120 | 2119 |
| | | L | RASQSIYKNLH | 2124 | 2123 | YASDSIS | 2126 | 2125 |
| IR-150 | 2b | H | TSGMGVS | 2134 | 2133 | HIYWDDDKRYNPSLKS | 2136 | 2135 |
| | | L | RSSQSLVHSNGNTYLH | 2140 | 2139 | KVSNRFS | 2142 | 2141 |
| IR-151 | 2b | H | TSGMGVS | 2150 | 2149 | HIYWDDDKRYNPSLKS | 2152 | 2151 |
| | | L | RSSQSIVHSNGNTYLE | 2156 | 2155 | KVSNRFS | 2158 | 2157 |
| IR-152 | 2b | H | SFGMH | 2166 | 2165 | YISSGSSTIYYADTVKG | 2168 | 2167 |
| | | L | RSSQSLVHSNGNTYLH | 2172 | 2171 | KVSNRFS | 2174 | 2173 |
| IR-153 | 2b | H | TSGMGVG | 2182 | 2181 | HIWWDDDKYYNPSLKS | 2184 | 2183 |
| | | L | RSSQSIVHSNGNTYLE | 2188 | 2187 | KVSNRFS | 2190 | 2189 |
| IR-154 | 2a | H | SFGMH | 2198 | 2197 | YISSGRSTIYYADTVKG | 2200 | 2199 |
| | | L | RSSQSLVHSNGNTYLH | 2204 | 2203 | KVSNRFS | 2206 | 2205 |
| IR-155 | 2a | H | SFGMH | 2214 | 2213 | YISSGSSTIYYADTVKG | 2216 | 2215 |
| | | L | RSSQSLVHSNGNTYLH | 2220 | 2219 | KVSNRFS | 2222 | 2221 |
| IR-156 | 2a | H | DYYMY | 2230 | 2229 | YISNGGGRTYYPDTVKG | 2232 | 2231 |
| | | L | RSSQSLVHSNGNTYLH | 2236 | 2235 | KVSNRFS | 2238 | 2237 |
| IR-157 | 2b | H | SFGMH | 2246 | 2245 | YISSGSSTIYYADTVKG | 2248 | 2247 |
| | | L | RSSQSIVHSNGNTYLE | 2252 | 2251 | KVSNRFS | 2254 | 2253 |
| IR-158 | 1 | H | SFGMH | 2262 | 2261 | YISGGSSTIYYADTVKG | 2264 | 2263 |
| | | L | RSSQSIVHSNGNTYLE | 2268 | 2267 | KVSNRFS | 2270 | 2269 |
| IR-159 | 1 | H | TSGMGVG | 2278 | 2277 | HIWWDDDKYYNPSLKS | 2280 | 2279 |
| | | L | RSSQSIVHSNGNTYLE | 2284 | 2283 | KVSNRFS | 2286 | 2285 |
| IR-160 | 2b | H | SFGMH | 2866 | 2865 | YISSGSSTIYYADTVKG | 2868 | 2867 |
| | | L | RSSQSLVHSNGNTYLH | 2872 | 2871 | KVSNRFS | 2874 | 2873 |
| IR-161 | 2b | H | SFGMH | 2882 | 2881 | YISSGSSTIYYADTLKG | 2884 | 2883 |
| | | L | KASQSVDYDGDSYMN | 2888 | 2887 | AASNLES | 2890 | 2889 |

TABLE 1-continued

| Name | class | chain | CDR3 | SEQ ID NO | SEQ ID NO (na) |
|---|---|---|---|---|---|
| IR-001 | 2b | H | KTSPEGGFAY | 10 | 9 |
|  |  | L | KQSYNLYT | 16 | 15 |
| IR-002 | 1 | H | STMIATGTFAY | 26 | 25 |
|  |  | L | FQGSHVPWT | 32 | 31 |
| IR-004 | 2b | H | YYGSSPFDY | 42 | 41 |
|  |  | L | SQSTHVPLT | 48 | 47 |
| IR-005 | 2b | H | LRQGFAY | 58 | 57 |
|  |  | L | FQGSHVPLT | 64 | 63 |
| IR-006 | 2b | H | YGSSFAY | 74 | 73 |
|  |  | L | KQSYNLYT | 80 | 79 |
| IR-007 | 2a | H | RGLLRRDAMDY | 90 | 89 |
|  |  | L | FQGSHVPLT | 96 | 95 |
| IR-008 | 2a | H | RALYGNLDYFDY | 106 | 105 |
|  |  | L | KQSYNLYT | 112 | 111 |
| IR-011 | 2b | H | SEVRRGAMDY | 122 | 121 |
|  |  | L | KQSYNLYT | 128 | 127 |
| IR-012 | 2a | H | RALYDYDYFDY | 138 | 137 |
|  |  | L | KQSYNLYT | 144 | 143 |
| IR-013 | 2b | H | GITTRYYTMDY | 154 | 153 |
|  |  | L | KQSYNLYT | 160 | 159 |
| IR-014 | 2a | H | RGLYDYDRFAY | 170 | 169 |
|  |  | L | FQGSHVPLT | 176 | 175 |
| IR-015 | 2a | H | GITTRYYTMDY | 186 | 185 |
|  |  | L | FQGSHVPLT | 192 | 191 |
| IR-017 | 2a | H | YGSSFAY | 202 | 201 |
|  |  | L | FQGSHVPLT | 208 | 207 |
| IR-020 | 2b | H | KGVYYDYDVGFAY | 218 | 217 |
|  |  | L | FQGSHVPLT | 224 | 223 |
| IR-021 | 2b | H | RALYYYGDYFDY | 234 | 233 |
|  |  | L | FQGSHVPLT | 240 | 239 |
| IR-022 | 2a | H | RGMITTDAMDY | 250 | 249 |
|  |  | L | FQGSHVPPT | 256 | 255 |
| IR-023 | 2b | H | YGRGFAY | 266 | 265 |
|  |  | L | FQGSHVPLT | 272 | 271 |
| IR-024 | 2a | H | QNWDGFAY | 282 | 281 |
|  |  | L | KQSYNLPT | 288 | 287 |
| IR-025 | 2a | H | RALYDYDAMDY | 298 | 297 |
|  |  | L | FQGSHVPPT | 304 | 303 |
| IR-026 | 2b | H | SAYYGNHFDY | 314 | 313 |
|  |  | L | FQGSHVPRT | 320 | 319 |
| IR-027 | 2b | H | GYRYDEGFAY | 330 | 329 |
|  |  | L | FQGSHVPPT | 336 | 335 |
| IR-028 | 2b | H | TGTGAMDY | 346 | 345 |
|  |  | L | SQSTHVPPT | 352 | 351 |
| IR-029 | 2b | H | RGLKKDYFDY | 362 | 361 |
|  |  | L | FQGSHVPLT | 368 | 367 |
| IR-030 | 1 | H | SAYYGNHFDY | 378 | 377 |
|  |  | L | FQGSHVPRT | 384 | 383 |
| IR-031 | 2a | H | LYGNIAY | 394 | 393 |
|  |  | L | FQGSHVPLT | 400 | 399 |
| IR-032 | 2b | H | IGRTTGNFDV | 410 | 409 |
|  |  | L | SQSTHVPPT | 416 | 415 |
| IR-033 | 2b | H | TGPVDY | 426 | 425 |
|  |  | L | VQGTHFPFM | 432 | 431 |
| IR-034 | 2b | H | IGRTTGNFDV | 442 | 441 |
|  |  | L | SQSTHVPPT | 448 | 447 |
| IR-035 | 2b | H | YGNGFAY | 458 | 457 |
|  |  | L | FQGSHVPLT | 464 | 463 |
| IR-036 | 2b | H | RANYYGYGMDAMDY | 474 | 473 |
|  |  | L | FQGSHVPLT | 480 | 479 |
| IR-037 | 1 | H | DGTMDY | 490 | 489 |
|  |  | L | LQVTHVPPT | 496 | 495 |
| IR-038 | 2b | H | GITTGFAY | 506 | 505 |
|  |  | L | FQGSHVPLT | 512 | 511 |
| IR-039 | 2b | H | RRQLGLRDAMDY | 522 | 521 |
|  |  | L | FQGSHVPLT | 528 | 527 |
| IR-040 | 2a | H | IGRTTGNFDV | 538 | 537 |
|  |  | L | SQSTHVPPT | 544 | 543 |
| IR-041 | 2a | H | RGYYALSY | 554 | 553 |
|  |  | L | FQGSHVPLT | 560 | 559 |
| IR-043 | 2a | H | RGLKKDYFDY | 570 | 569 |
|  |  | L | FQGSHVPLT | 576 | 575 |
| IR-044 | 1 | H | RASRGTDAMDY | 586 | 585 |
|  |  | L | FQGSHVPLT | 592 | 591 |
| IR-045 | 2b | H | YLYYYGSSYE | 602 | 601 |
|  |  | L | SQSTHVPWT | 608 | 607 |

TABLE 1-continued

| | | | | | |
|---|---|---|---|---|---|
| IR-046 | 2a | H | RRQLGLRDAMDY | 618 | 617 |
| | | L | FQGSHVPLT | 624 | 623 |
| IR-048 | 2a | H | RNLYRYDLFDY | 634 | 633 |
| | | L | FQGSHVPLT | 640 | 639 |
| IR-049 | 1 | H | RGLKKDYFDY | 650 | 649 |
| | | L | FQGSHVPLT | 656 | 655 |
| IR-050 | 2a | H | GYRYDEGFAY | 666 | 665 |
| | | L | FQGSHVPPT | 672 | 671 |
| IR-051 | 2b | H | YVYDSFAY | 682 | 681 |
| | | L | FQGSHVPLT | 688 | 687 |
| IR-052 | 2a | H | RTTARARDYFDY | 698 | 697 |
| | | L | FQGSHVPLT | 704 | 703 |
| IR-053 | 1 | H | YYGRGGAMDY | 714 | 713 |
| | | L | FQGSHVPPT | 720 | 719 |
| IR-054 | 1 | H | EGYRYLFDY | 730 | 729 |
| | | L | SQSTHVPWT | 736 | 735 |
| IR-055 | 1 | H | RALWYPWFAY | 746 | 745 |
| | | L | FQGSHVPLT | 752 | 751 |
| IR-056 | 2b | H | SARSYGAMDY | 762 | 761 |
| | | L | FQGSHVPLT | 768 | 767 |
| IR-057 | 1 | H | YGNYAMDY | 778 | 777 |
| | | L | FQGSHVPPT | 784 | 783 |
| IR-058 | 1 | H | EGNMDY | 794 | 793 |
| | | L | SQSTHVPPT | 800 | 799 |
| IR-059 | 2b | H | RRGYGYDY | 810 | 809 |
| | | L | FQGSHVPLT | 816 | 815 |
| IR-060 | 2a | H | GGNYLRYYAMDY | 826 | 325 |
| | | L | FQGSHVPLT | 832 | 831 |
| IR-061 | 2b | H | APTMITGGFAY | 842 | 841 |
| | | L | FQGSHVPLT | 848 | 847 |
| IR-062 | 2b | H | YYHYAMDY | 858 | 857 |
| | | L | FQGSHVPPT | 864 | 863 |
| IR-063 | 2b | H | EGDFDY | 874 | 873 |
| | | L | SQSTHVPLT | 880 | 879 |
| IR-064 | 2b | H | RAGGFAY | 890 | 389 |
| | | L | FQGSHVPLT | 896 | 895 |
| IR-065 | 2b | H | YYGSSYAMDY | 906 | 905 |
| | | L | FQGSHVPLT | 912 | 911 |
| IR-066 | 2b | H | KAYYRYGYAMDY | 922 | 921 |
| | | L | FQGSHVPLT | 928 | 927 |
| IR-067 | 2b | H | SGGNYLMDY | 938 | 937 |
| | | L | FQGSHVPLT | 944 | 943 |
| IR-068 | 1 | H | SGTTATIDY | 954 | 953 |
| | | L | FQGSHVPPT | 960 | 959 |
| IR-069 | 2b | H | RHWNYAMDY | 970 | 969 |
| | | L | FQGSHVPLT | 976 | 975 |
| IR-070 | 2b | H | DETTATFAY | 986 | 985 |
| | | L | SQSTHVPPT | 992 | 991 |
| IR-071 | 2b | H | VWSGAMDY | 1002 | 1001 |
| | | L | FQGSHVPPT | 1008 | 1007 |
| IR-072 | 1 | H | RALLLRYPNAMDY | 1018 | 1017 |
| | | L | FQGSHVPLT | 1024 | 1023 |
| IR-073 | 2b | H | YGYYLYYAMDY | 1034 | 1033 |
| | | L | FQGSHYPLT | 1040 | 1039 |
| IR-074 | 2a | H | LLRLGYFDV | 1050 | 1049 |
| | | L | SQSTHYPLT | 1056 | 1055 |
| IR-075 | 2b | H | LGTGTGAMDY | 1066 | 1065 |
| | | L | SQSTHYPWT | 1072 | 1071 |
| IR-076 | 2b | H | RGIYGYYAMDY | 1082 | 1081 |
| | | L | FQGSHYPLT | 1088 | 1087 |
| IR-077 | 2a | H | SGYRYSYYAMDY | 1098 | 1097 |
| | | L | FQGSHVPLT | 1104 | 1103 |
| IR-078 | 2b | H | WDGRGYFDY | 1114 | 1113 |
| | | L | SQSTHVPLT | 1120 | 1119 |
| IR-079 | 2b | H | YGTLYYYAMDY | 1130 | 1129 |
| | | L | FQGSHVPPT | 1136 | 1135 |
| IR-080 | 2a | H | GMITTAFAY | 1146 | 1145 |
| | | L | FQGSHVPLT | 1152 | 1151 |
| IR-081 | 2b | H | RWGEGAMDY | 1162 | 1161 |
| | | L | FQGSHVPPT | 1168 | 1167 |
| IR-082 | 2b | H | SNLLDY | 1178 | 1177 |
| | | L | LQVTHVPPT | 1184 | 1183 |
| IR-083 | 2b | H | RGYYEAMDY | 1194 | 1193 |
| | | L | FQGSHVPPT | 1200 | 1199 |
| IR-084 | 2b | H | FITTRGAMDY | 1210 | 1209 |
| | | L | FQGSHVPLT | 1216 | 1215 |
| IR-085 | 2b | H | DGYGRGGYAMDY | 1226 | 1225 |
| | | L | FQGSHVPLT | 1232 | 1231 |
| IR-086 | 2a | H | RGYYEAMDY | 1242 | 1241 |
| | | L | FQGSHVPPT | 1248 | 1247 |

TABLE 1-continued

| | | | | | |
|---|---|---|---|---|---|
| IR-087 | 2b | H | YSSRAMDY | 1258 | 1257 |
| | | L | FQGSHVPLT | 1264 | 1263 |
| IR-088 | 1 | H | RIYGSGLFAY | 1274 | 1273 |
| | | L | QNDYSYPLT | 1280 | 1279 |
| IR-089 | 2a | H | SGTGTGAMDY | 1290 | 1289 |
| | | L | SQSTHVPWT | 1296 | 1295 |
| IR-090 | 2b | H | SGGYRYYYAMDY | 1306 | 1305 |
| | | L | FQGSHVPLT | 1312 | 1311 |
| IR-092 | 2a | H | SRYGNFAY | 1322 | 1321 |
| | | L | FQGSHVPLT | 1328 | 1327 |
| IR-093 | 2a | H | LGLKLGNLDY | 1338 | 1337 |
| | | L | SQSTHVPFT | 1344 | 1343 |
| IR-094 | 2b | H | RGPSGYDRAWFAY | 1354 | 1353 |
| | | L | QQYYSYWT | 1360 | 1359 |
| IR-095 | 2b | H | RAPRLYYGYDAMDY | 1370 | 1369 |
| | | L | FQGSHVPLT | 1376 | 1375 |
| IR-097 | 2b | H | RGLRLRDAMDY | 1386 | 1385 |
| | | L | FQGSHVPLT | 1392 | 1391 |
| IR-098 | 2b | H | SRYGNFAY | 1402 | 1401 |
| | | L | FQGSHVPLT | 1408 | 1407 |
| IR-100 | 2b | H | YGSSYGGTFDY | 1418 | 1417 |
| | | L | SQSTHVPLT | 1424 | 1423 |
| IR-101 | 2b | H | SELLAY | 1434 | 1433 |
| | | L | LQVTHVPPT | 1440 | 1439 |
| IR-102 | 1 | H | RGLRLRDAMDY | 1450 | 1449 |
| | | L | FQGSHVPLT | 1456 | 1455 |
| IR-104 | 2b | H | RARTGLDY | 1466 | 1465 |
| | | L | FQGSHVPLT | 1472 | 1471 |
| IR-105 | 2b | H | YDAY | 1482 | 1481 |
| | | L | FQGSHVPLT | 1488 | 1487 |
| IR-106 | 2b | H | SPRGTSFAY | 1438 | 1437 |
| | | L | FQGSHVPLT | 1504 | 1503 |
| IR-107 | 2b | H | YGYAMDY | 1514 | 1513 |
| | | L | FQGSHVPPT | 1520 | 1519 |
| IR-108 | 2a | H | RGLRRGDYFDY | 1530 | 1529 |
| | | L | FQGSHVPLT | 1536 | 1535 |
| IR-109 | 2a | H | YYYAMDY | 1546 | 1545 |
| | | L | FQGSHVPLT | 1552 | 1551 |
| IR-110 | 2b | H | YGNYGAY | 1562 | 1561 |
| | | L | FQGSHVPPT | 1568 | 1567 |
| IR-112 | 2a | H | RSMITTNDYFDY | 1578 | 1577 |
| | | L | FQGSHVPPT | 1584 | 1583 |
| IR-114 | 2a | H | YGYYAMDY | 1594 | 1593 |
| | | L | FQGSHVPPT | 1600 | 1599 |
| IR-115 | 2b | H | SDYGNSFAY | 1610 | 1603 |
| | | L | SQSTHVPLT | 1616 | 1615 |
| IR-116 | 2b | H | LWYDGGPAY | 1626 | 1625 |
| | | L | SQSTHVPLT | 1632 | 1631 |
| IR-117 | 2b | H | YGYDAMDY | 1642 | 1641 |
| | | L | SQSTHVPLT | 1648 | 1647 |
| IR-118 | 2a | H | HSYRYGLMDY | 1658 | 1657 |
| | | L | SQSTHVPLT | 1664 | 1663 |
| IR-119 | 2b | H | PRTGTGAMDY | 1674 | 1673 |
| | | L | SQSTHVPLT | 1680 | 1679 |
| IR-120 | 2b | H | RKVTGTLGLDAMDY | 1680 | 1689 |
| | | L | FQGSLVPPT | 1696 | 1695 |
| IR-121 | 2b | H | YGIYAMDY | 1706 | 1705 |
| | | L | FQGSHVPPT | 1712 | 1711 |
| IR-122 | 2b | H | YGNYGYYAMDY | 1722 | 1721 |
| | | L | FQGSHVPLT | 1728 | 1727 |
| IR-123 | 2a | H | SRGYFDV | 1738 | 1737 |
| | | L | FQGSHVPPT | 1744 | 1743 |
| IR-124 | 2a | H | YYYGSSYY | 1754 | 1753 |
| | | L | FQGSHVPPT | 1760 | 1759 |
| IR-125 | 2b | H | AGGYSLSYAMDY | 1770 | 1769 |
| | | L | FQGSHVPPT | 1776 | 1775 |
| IR-126 | 2a | H | LWYDGGPAY | 1786 | 1785 |
| | | L | SQSTHVPLT | 1792 | 1791 |
| IR-127 | 2a | H | KGTYYRYDAFDY | 1802 | 1801 |
| | | L | FQGSHVPPT | 1808 | 1807 |
| IR-128 | 2a | H | EGHFDY | 1818 | 1817 |
| | | L | SQSTHVPPT | 1824 | 1823 |
| IR-129 | 2b | H | FAY | 1834 | 1833 |
| | | L | FQGSHVPPT | 1840 | 1839 |
| IR-131 | 2a | H | GTSYGSGLHYYAMDY | 1850 | 1849 |
| | | L | SQSTHVPLT | 1856 | 1855 |
| IR-132 | 2b | H | DGNYVGWFAY | 1866 | 1865 |
| | | L | SQSTHVPLT | 1872 | 1871 |
| IR-133 | 2b | H | RGRYYAMDY | 1882 | 1881 |
| | | L | FQGSHVPLT | 1888 | 1887 |

TABLE 1-continued

| | | | | | | |
|---|---|---|---|---|---|---|
| IR-134 | 2a | H | ARRGYAMDY | 1888 | 1887 |
| | | L | QNDYSYPT | 1904 | 1903 |
| IR-135 | 2a | H | YGSSYGYFDV | 1914 | 1913 |
| | | L | SQSTHVPLT | 1920 | 1919 |
| IR-136 | 2a | H | SNYVIYYAMDY | 1930 | 1929 |
| | | L | FQGSHVPLT | 1936 | 1935 |
| IR-137 | 2a | H | IGFGYYYAMDY | 1946 | 1945 |
| | | L | SQSTHVPWT | 1952 | 1951 |
| IR-138 | 2b | H | YDGYY | 1962 | 1961 |
| | | L | FQGSHVPLT | 1968 | 1967 |
| IR-139 | 2b | H | DEGYFDY | 1378 | 1377 |
| | | L | SQSTHVPLT | 1984 | 1983 |
| IR-140 | 2b | H | KGTYYRYDAFDY | 1994 | 1933 |
| | | L | FQGSHVPPT | 2000 | 1999 |
| IR-141 | 2b | H | YGKIPFDY | 2010 | 2009 |
| | | L | SQSTHVPLT | 2016 | 2015 |
| IR-142 | 2a | H | RELRLPWFAY | 2026 | 2025 |
| | | L | FQGSHVPLT | 2032 | 2031 |
| IR-143 | 2b | H | DYGSSSFAY | 2042 | 2041 |
| | | L | SQSTHVPLT | 2048 | 2047 |
| IR-144 | 2a | H | ERKIHYYGYDY | 2058 | 2057 |
| | | L | FQGSHVPYT | 2064 | 2063 |
| IR-145 | 2b | H | IYYGSSGAFAY | 2074 | 2073 |
| | | L | FQGSHVPPT | 2080 | 2079 |
| IR-146 | 2a | H | GGTGAMDY | 2090 | 2089 |
| | | L | FQGSHVPPT | 2096 | 2095 |
| IR-147 | 2b | H | RARRYAMDY | 2106 | 2105 |
| | | L | FQGSHVPLT | 2112 | 2111 |
| IR-149 | 2a | H | RAGGFAY | 2122 | 2121 |
| | | L | LQGYSTPMYT | 2128 | 2127 |
| IR-150 | 2b | H | GSNFDY | 2138 | 2137 |
| | | L | SQSTHVPLT | 2144 | 2143 |
| IR-151 | 2b | H | RGVYYRYDDAMDY | 2154 | 2153 |
| | | L | FQGSHVPLT | 2160 | 2159 |
| IR-152 | 2b | H | GGHVGAMDY | 2170 | 2169 |
| | | L | SQSTHVPWT | 2176 | 2175 |
| IR-153 | 2b | H | SATTGTKGTMDY | 2186 | 2185 |
| | | L | FQGSHVPLT | 2192 | 2191 |
| IR-154 | 2a | H | LRGNLDYAMDY | 2202 | 2201 |
| | | L | SQSTHVPFT | 2208 | 2207 |
| IR-155 | 2a | H | LDGYRGDY | 2218 | 2217 |
| | | L | SQSTHVPLT | 2224 | 2223 |
| IR-156 | 2a | H | GTSYGSGLHYYAMDY | 2234 | 2233 |
| | | L | SQSTHVPLT | 2240 | 2239 |
| IR-157 | 2b | H | YYYYAMDY | 2250 | 2249 |
| | | L | FQGSHVPPT | 2256 | 2255 |
| IR-158 | 1 | H | SPFLRLQGLAY | 2266 | 2265 |
| | | L | FQGSHVPPT | 2272 | 2271 |
| IR-159 | 1 | H | RASRGTDAMDY | 2282 | 2281 |
| | | L | FQGSHVPLT | 2288 | 2287 |
| IR-160 | 2b | H | GNYPDY | 2870 | 2869 |
| | | L | SQSTHVPPT | 2876 | 2875 |
| IR-161 | 2b | H | YGNYAMDY | 2886 | 2885 |
| | | L | QQSNEDPRT | 2892 | 2891 |

Some of the obtained VH and VL sequences contained signal peptides or lacked N-terminal or C-terminal sequences. If sequences are lacked, they are supplemented. Thus, the VH and VL sequences without signal sequences were determined based on the homology with previously-reported antibody sequences.

The VH amino acid sequences, excluding signal peptides, of each antibody are shown in the following SEQ ID NOs:

SEQ ID NO: 2290 (IR-001), SEQ ID NO: 2294 (IR-002), SEQ ID NO: 2298 (IR-004), SEQ ID NO: 2302 (IR-005), SEQ ID NO: 2306 (IR-006), SEQ ID NO: 2310 (IR-007), SEQ ID NO: 2314 (IR-008), SEQ ID NO: 2318 (IR-011), SEQ ID NO: 2322 (IR-012), SEQ ID NO: 2326 (IR-013), SEQ ID NO: 2330 (IR-014), SEQ ID NO: 2334 (IR-015), SEQ ID NO: 2338 (IR-017), SEQ ID NO: 2342 (IR-020), SEQ ID NO: 2346 (IR-021), SEQ ID NO: 2350 (IR-022), SEQ ID NO: 2354 (IR-023), SEQ ID NO: 2358 (IR-024), SEQ ID NO: 2362 (IR-025), SEQ ID NO: 2366 (IR-026), SEQ ID NO: 2370 (IR-027), SEQ ID NO: 2374 (IR-028), SEQ ID NO: 2378 (IR-029), SEQ ID NO: 2382 (IR-030), SEQ ID NO: 2386 (IR-031), SEQ ID NO: 2390 (IR-032), SEQ ID NO: 2394 (IR-033), SEQ ID NO: 2398 (IR-034), SEQ ID NO: 2402 (IR-035), SEQ ID NO: 2406 (IR-036), SEQ ID NO: 2410 (IR-037), SEQ ID NO: 2414 (IR-038), SEQ ID NO: 2418 (IR-039), SEQ ID NO: 2422 (IR-040), SEQ ID NO: 2426 (IR-041), SEQ ID NO: 2430 (IR-043), SEQ ID NO: 2434 (IR-044), SEQ ID NO: 2438 (IR-045), SEQ ID NO: 2442 (IR-046), SEQ ID NO: 2446 (IR-048), SEQ ID NO: 2450 (IR-049), SEQ ID NO: 2454 (IR-050), SEQ ID NO: 2458 (IR-051), SEQ ID NO: 2462 (IR-052), SEQ ID NO: 2466 (IR-053), SEQ ID NO: 2470 (IR-054), SEQ ID NO: 2474 (IR-055), SEQ ID NO: 2478 (IR-056), SEQ ID NO: 2482 (IR-057), SEQ ID NO: 2486 (IR-058), SEQ ID NO: 2490 (IR-059), SEQ ID NO: 2494 (IR-060), SEQ ID NO: 2498 (IR-061), SEQ ID NO: 2502 (IR-062), SEQ ID NO: 2506 (IR-063), SEQ ID NO: 2510 (IR-064), SEQ ID NO: 2514 (IR-065), SEQ ID NO: 2518 (IR-066), SEQ ID NO: 2522 (IR-067), SEQ ID NO: 2526 (IR-068),

SEQ ID NO: 2530 (IR-069), SEQ ID NO: 2534 (IR-070), SEQ ID NO: 2538 (IR-071), SEQ ID NO: 2542 (IR-072), SEQ ID NO: 2546 (IR-073), SEQ ID NO: 2550 (IR-074), SEQ ID NO: 2554 (IR-075), SEQ ID NO: 2558 (IR-076), SEQ ID NO: 2562 (IR-077), SEQ ID NO: 2566 (IR-078), SEQ ID NO: 2570 (IR-079), SEQ ID NO: 2574 (IR-080), SEQ ID NO: 2578 (IR-081), SEQ ID NO: 2582 (IR-082), SEQ ID NO: 2586 (IR-083), SEQ ID NO: 2590 (IR-084), SEQ ID NO: 2594 (IR-085), SEQ ID NO: 2598 (IR-086), SEQ ID NO: 2602 (IR-087), SEQ ID NO: 2606 (IR-088), SEQ ID NO: 2610 (IR-089), SEQ ID NO: 2614 (IR-090), SEQ ID NO: 2618 (IR-092), SEQ ID NO: 2622 (IR-093), SEQ ID NO: 2626 (IR-094), SEQ ID NO: 2630 (IR-095), SEQ ID NO: 2634 (IR-097), SEQ ID NO: 2638 (IR-098), SEQ ID NO: 2642 (IR-100), SEQ ID NO: 2646 (IR-101), SEQ ID NO: 2650 (IR-102), SEQ ID NO: 2654 (IR-104), SEQ ID NO: 2658 (IR-105), SEQ ID NO: 2662 (IR-106), SEQ ID NO: 2666 (IR-107), SEQ ID NO: 2670 (IR-108), SEQ ID NO: 2674 (IR-109), SEQ ID NO: 2678 (IR-110), SEQ ID NO: 2682 (IR-112), SEQ ID NO: 2686 (IR-114), SEQ ID NO: 2690 (IR-115), SEQ ID NO: 2694 (IR-116), SEQ ID NO: 2698 (IR-117), SEQ ID NO: 2702 (IR-118), SEQ ID NO: 2706 (IR-119), SEQ ID NO: 2710 (IR-120), SEQ ID NO: 2714 (IR-121), SEQ ID NO: 2718 (IR-122), SEQ ID NO: 2722 (IR-123), SEQ ID NO: 2726 (IR-124), SEQ ID NO: 2730 (IR-125), SEQ ID NO: 2734 (IR-126), SEQ ID NO: 2738 (IR-127), SEQ ID NO: 2742 (IR-128), SEQ ID NO: 2746 (IR-129), SEQ ID NO: 2750 (IR-131), SEQ ID NO: 2754 (IR-132), SEQ ID NO: 2758 (IR-133), SEQ ID NO: 2762 (IR-134), SEQ ID NO: 2766 (IR-135), SEQ ID NO: 2770 (IR-136), SEQ ID NO: 2774 (IR-137), SEQ ID NO: 2778 (IR-138), SEQ ID NO: 2782 (IR-139), SEQ ID NO: 2786 (IR-140), SEQ ID NO: 2790 (IR-141), SEQ ID NO: 2794 (IR-142), SEQ ID NO: 2798 (IR-143), SEQ ID NO: 2802 (IR-144), SEQ ID NO: 2806 (IR-145), SEQ ID NO: 2810 (IR-146), SEQ ID NO: 2814 (IR-147), SEQ ID NO: 2818 (IR-149), SEQ ID NO: 2822 (IR-150), SEQ ID NO: 2826 (IR-151), SEQ ID NO: 2830 (IR-152), SEQ ID NO: 2834 (IR-153), SEQ ID NO: 2838 (IR-154), SEQ ID NO: 2842 (IR-155), SEQ ID NO: 2846 (IR-156), SEQ ID NO: 2850 (IR-157), SEQ ID NO: 2854 (IR-158), SEQ ID NO: 2858 (IR-159), SEQ ID NO: 2862 (IR-160), and SEQ ID NO: 2878 (IR-161).

The nucleotide sequences corresponding to the above amino acid sequences are as follows:

SEQ ID NO: 2289 (IR-001), SEQ ID NO: 2293 (IR-002), SEQ ID NO: 2297 (IR-004), SEQ ID NO: 2301 (IR-005), SEQ ID NO: 2305 (IR-006), SEQ ID NO: 2309 (IR-007), SEQ ID NO: 2313 (IR-008), SEQ ID NO: 2317 (IR-011), SEQ ID NO: 2321 (IR-012), SEQ ID NO: 2325 (IR-013), SEQ ID NO: 2329 (IR-014), SEQ ID NO: 2333 (IR-015), SEQ ID NO: 2337 (IR-017), SEQ ID NO: 2341 (IR-020), SEQ ID NO: 2345 (IR-021), SEQ ID NO: 2349 (IR-022), SEQ ID NO: 2353 (IR-023), SEQ ID NO: 2357 (IR-024), SEQ ID NO: 2361 (IR-025), SEQ ID NO: 2365 (IR-026), SEQ ID NO: 2369 (IR-027), SEQ ID NO: 2373 (IR-028), SEQ ID NO: 2377 (IR-029), SEQ ID NO: 2381 (IR-030), SEQ ID NO: 2385 (IR-031), SEQ ID NO: 2389 (IR-032), SEQ ID NO: 2393 (IR-033), SEQ ID NO: 2397 (IR-034), SEQ ID NO: 2401 (IR-035), SEQ ID NO: 2405 (IR-036), SEQ ID NO: 2409 (IR-037), SEQ ID NO: 2413 (IR-038), SEQ ID NO: 2417 (IR-039), SEQ ID NO: 2421 (IR-040), SEQ ID NO: 2425 (IR-041), SEQ ID NO: 2429 (IR-043), SEQ ID NO: 2433 (IR-044), SEQ ID NO: 2437 (IR-045), SEQ ID NO: 2441 (IR-046), SEQ ID NO: 2445 (IR-048), SEQ ID NO: 2449 (IR-049), SEQ ID NO: 2453 (IR-050), SEQ ID NO: 2457 (IR-051), SEQ ID NO: 2461 (IR-052), SEQ ID NO: 2465 (IR-053), SEQ ID NO: 2469 (IR-054), SEQ ID NO: 2473 (IR-055), SEQ ID NO: 2477 (IR-056), SEQ ID NO: 2481 (IR-057), SEQ ID NO: 2485 (IR-058), SEQ ID NO: 2489 (IR-059), SEQ ID NO: 2493 (IR-060), SEQ ID NO: 2497 (IR-061), SEQ ID NO: 2501 (IR-062), SEQ ID NO: 2505 (IR-063), SEQ ID NO: 2509 (IR-064), SEQ ID NO: 2513 (IR-065), SEQ ID NO: 2517 (IR-066), SEQ ID NO: 2521 (IR-067), SEQ ID NO: 2525 (IR-068), SEQ ID NO: 2529 (IR-069), SEQ ID NO: 2533 (IR-070), SEQ ID NO: 2537 (IR-071), SEQ ID NO: 2541 (IR-072), SEQ ID NO: 2545 (IR-073), SEQ ID NO: 2549 (IR-074), SEQ ID NO: 2553 (IR-075), SEQ ID NO: 2557 (IR-076), SEQ ID NO: 2561 (IR-077), SEQ ID NO: 2565 (IR-078), SEQ ID NO: 2569 (IR-079), SEQ ID NO: 2573 (IR-080), SEQ ID NO: 2577 (IR-081), SEQ ID NO: 2581 (IR-082), SEQ ID NO: 2585 (IR-083), SEQ ID NO: 2589 (IR-084), SEQ ID NO: 2593 (IR-085), SEQ ID NO: 2597 (IR-086), SEQ ID NO: 2601 (IR-087), SEQ ID NO: 2605 (IR-088), SEQ ID NO: 2609 (IR-089), SEQ ID NO: 2613 (IR-090), SEQ ID NO: 2617 (IR-092), SEQ ID NO: 2621 (IR-093), SEQ ID NO: 2625 (IR-094), SEQ ID NO: 2629 (IR-095), SEQ ID NO: 2633 (IR-097), SEQ ID NO: 2637 (IR-098), SEQ ID NO: 2641 (IR-100), SEQ ID NO: 2645 (IR-101), SEQ ID NO: 2649 (IR-102), SEQ ID NO: 2653 (IR-104), SEQ ID NO: 2657 (IR-105), SEQ ID NO: 2661 (IR-106), SEQ ID NO: 2665 (IR-107), SEQ ID NO: 2669 (IR-108), SEQ ID NO: 2673 (IR-109), SEQ ID NO: 2677 (IR-110), SEQ ID NO: 2681 (IR-112), SEQ ID NO: 2685 (IR-114), SEQ ID NO: 2689 (IR-115), SEQ ID NO: 2693 (IR-116), SEQ ID NO: 2697 (IR-117), SEQ ID NO: 2701 (IR-118), SEQ ID NO: 2705 (IR-119), SEQ ID NO: 2709 (IR-120), SEQ ID NO: 2713 (IR-121), SEQ ID NO: 2717 (IR-122), SEQ ID NO: 2721 (IR-123), SEQ ID NO: 2725 (IR-124), SEQ ID NO: 2729 (IR-125), SEQ ID NO: 2733 (IR-126), SEQ ID NO: 2737 (IR-127), SEQ ID NO: 2741 (IR-128), SEQ ID NO: 2745 (IR-129), SEQ ID NO: 2749 (IR-131), SEQ ID NO: 2753 (IR-132), SEQ ID NO: 2757 (IR-133), SEQ ID NO: 2761 (IR-134), SEQ ID NO: 2765 (IR-135), SEQ ID NO: 2769 (IR-136), SEQ ID NO: 2773 (IR-137), SEQ ID NO: 2777 (IR-138), SEQ ID NO: 2781 (IR-139), SEQ ID NO: 2785 (IR-140), SEQ ID NO: 2789 (IR-141), SEQ ID NO: 2793 (IR-142), SEQ ID NO: 2797 (IR-143), SEQ ID NO: 2801 (IR-144), SEQ ID NO: 2805 (IR-145), SEQ ID NO: 2809 (IR-146), SEQ ID NO: 2813 (IR-147), SEQ ID NO: 2817 (IR-149), SEQ ID NO: 2821 (IR-150), SEQ ID NO: 2825 (IR-151), SEQ ID NO: 2829 (IR-152), SEQ ID NO: 2833 (IR-153), SEQ ID NO: 2837 (IR-154), SEQ ID NO: 2841 (IR-155), SEQ ID NO: 2845 (IR-156), SEQ ID NO: 2849 (IR-157), SEQ ID NO: 2853 (IR-158), SEQ ID NO: 2857 (IR-159), SEQ ID NO: 2861 (IR-160), and SEQ ID NO: 2877 (IR-161).

The VL amino acid sequences, excluding signal peptides, of each antibody are shown in the following SEQ ID NOs:

SEQ ID NO: 2292 (IR-001), SEQ ID NO: 2296 (IR-002), SEQ ID NO: 2300 (IR-004), SEQ ID NO: 2304 (IR-005), SEQ ID NO: 2308 (IR-006), SEQ ID NO: 2312 (IR-007), SEQ ID NO: 2316 (IR-008), SEQ ID NO: 2320 (IR-011), SEQ ID NO: 2324 (IR-012), SEQ ID NO: 2328 (IR-013), SEQ ID NO: 2332 (IR-014), SEQ ID NO: 2336 (IR-015), SEQ ID NO: 2340 (IR-017), SEQ ID NO: 2344 (IR-020), SEQ ID NO: 2348 (IR-021), SEQ ID NO: 2352 (IR-022), SEQ ID NO: 2356 (IR-023), SEQ ID NO: 2360 (IR-024), SEQ ID NO: 2364 (IR-025), SEQ ID NO: 2368 (IR-026), SEQ ID NO: 2372 (IR-027), SEQ ID NO: 2376 (IR-028), SEQ ID NO: 2380 (IR-029), SEQ ID NO: 2384 (IR-030), SEQ ID NO: 2388 (IR-031), SEQ ID NO: 2392 (IR-032), SEQ ID NO: 2396 (IR-033), SEQ ID NO: 2400 (IR-034),

SEQ ID NO: 2404 (IR-035), SEQ ID NO: 2408 (IR-036), SEQ ID NO: 2412 (IR-037), SEQ ID NO: 2416 (IR-038), SEQ ID NO: 2420 (IR-039), SEQ ID NO: 2424 (IR-040), SEQ ID NO: 2428 (IR-041), SEQ ID NO: 2432 (IR-043), SEQ ID NO: 2436 (IR-044), SEQ ID NO: 2440 (IR-045), SEQ ID NO: 2444 (IR-046), SEQ ID NO: 2448 (IR-048), SEQ ID NO: 2452 (IR-049), SEQ ID NO: 2456 (IR-050), SEQ ID NO: 2460 (IR-051), SEQ ID NO: 2464 (IR-052), SEQ ID NO: 2468 (IR-053), SEQ ID NO: 2472 (IR-054), SEQ ID NO: 2476 (IR-055), SEQ ID NO: 2480 (IR-056), SEQ ID NO: 2484 (IR-057), SEQ ID NO: 2488 (IR-058), SEQ ID NO: 2492 (IR-059), SEQ ID NO: 2496 (IR-060), SEQ ID NO: 2500 (IR-061), SEQ ID NO: 2504 (IR-062), SEQ ID NO: 2508 (IR-063), SEQ ID NO: 2512 (IR-064), SEQ ID NO: 2516 (IR-065), SEQ ID NO: 2520 (IR-066), SEQ ID NO: 2524 (IR-067), SEQ ID NO: 2528 (IR-068), SEQ ID NO: 2532 (IR-069), SEQ ID NO: 2536 (IR-070), SEQ ID NO: 2540 (IR-071), SEQ ID NO: 2544 (IR-072), SEQ ID NO: 2548 (IR-073), SEQ ID NO: 2552 (IR-074), SEQ ID NO: 2556 (IR-075), SEQ ID NO: 2560 (IR-076), SEQ ID NO: 2564 (IR-077), SEQ ID NO: 2568 (IR-078), SEQ ID NO: 2572 (IR-079), SEQ ID NO: 2576 (IR-080), SEQ ID NO: 2580 (IR-081), SEQ ID NO: 2584 (IR-082), SEQ ID NO: 2588 (IR-083), SEQ ID NO: 2592 (IR-084), SEQ ID NO: 2596 (IR-085), SEQ ID NO: 2600 (IR-086), SEQ ID NO: 2604 (IR-087), SEQ ID NO: 2608 (IR-088), SEQ ID NO: 2612 (IR-089), SEQ ID NO: 2616 (IR-090), SEQ ID NO: 2620 (IR-092), SEQ ID NO: 2624 (IR-093), SEQ ID NO: 2628 (IR-094), SEQ ID NO: 2632 (IR-095), SEQ ID NO: 2636 (IR-097), SEQ ID NO: 2640 (IR-098), SEQ ID NO: 2644 (IR-100), SEQ ID NO: 2648 (IR-101), SEQ ID NO: 2652 (IR-102), SEQ ID NO: 2656 (IR-104), SEQ ID NO: 2660 (IR-105), SEQ ID NO: 2664 (IR-106), SEQ ID NO: 2668 (IR-107), SEQ ID NO: 2672 (IR-108), SEQ ID NO: 2676 (IR-109), SEQ ID NO: 2680 (IR-110), SEQ ID NO: 2684 (IR-112), SEQ ID NO: 2688 (IR-114), SEQ ID NO: 2692 (IR-115), SEQ ID NO: 2696 (IR-116), SEQ ID NO: 2700 (IR-117), SEQ ID NO: 2704 (IR-118), SEQ ID NO: 2708 (IR-119), SEQ ID NO: 2712 (IR-120), SEQ ID NO: 2716 (IR-121), SEQ ID NO: 2720 (IR-122), SEQ ID NO: 2724 (IR-123), SEQ ID NO: 2728 (IR-124), SEQ ID NO: 2732 (IR-125), SEQ ID NO: 2736 (IR-126), SEQ ID NO: 2740 (IR-127), SEQ ID NO: 2744 (IR-128), SEQ ID NO: 2748 (IR-129), SEQ ID NO: 2752 (IR-131), SEQ ID NO: 2756 (IR-132), SEQ ID NO: 2760 (IR-133), SEQ ID NO: 2764 (IR-134), SEQ ID NO: 2768 (IR-135), SEQ ID NO: 2772 (IR-136), SEQ ID NO: 2776 (IR-137), SEQ ID NO: 2780 (IR-138), SEQ ID NO: 2784 (IR-139), SEQ ID NO: 2788 (IR-140), SEQ ID NO: 2792 (IR-141), SEQ ID NO: 2796 (IR-142), SEQ ID NO: 2800 (IR-143), SEQ ID NO: 2804 (IR-144), SEQ ID NO: 2808 (IR-145), SEQ ID NO: 2812 (IR-146), SEQ ID NO: 2816 (IR-147), SEQ ID NO: 2820 (IR-149), SEQ ID NO: 2824 (IR-150), SEQ ID NO: 2828 (IR-151), SEQ ID NO: 2832 (IR-152), SEQ ID NO: 2836 (IR-153), SEQ ID NO: 2840 (IR-154), SEQ ID NO: 2844 (IR-155), SEQ ID NO: 2848 (IR-156), SEQ ID NO: 2852 (IR-157), SEQ ID NO: 2856 (IR-158), SEQ ID NO: 2860 (IR-159), SEQ ID NO: 2864 (IR-160), and SEQ ID NO: 2880 (IR-161).

The nucleotide sequences corresponding to the above amino acid sequences are as follows:

SEQ ID NO: 2291 (IR-001), SEQ ID NO: 2295 (IR-002), SEQ ID NO: 2299 (IR-004), SEQ ID NO: 2303 (IR-005), SEQ ID NO: 2307 (IR-006), SEQ ID NO: 2311 (IR-007), SEQ ID NO: 2315 (IR-008), SEQ ID NO: 2319 (IR-011), SEQ ID NO: 2323 (IR-012), SEQ ID NO: 2327 (IR-013), SEQ ID NO: 2331 (IR-014), SEQ ID NO: 2335 (IR-015), SEQ ID NO: 2339 (IR-017), SEQ ID NO: 2343 (IR-020), SEQ ID NO: 2347 (IR-021), SEQ ID NO: 2351 (IR-022), SEQ ID NO: 2355 (IR-023), SEQ ID NO: 2359 (IR-024), SEQ ID NO: 2363 (IR-025), SEQ ID NO: 2367 (IR-026), SEQ ID NO: 2371 (IR-027), SEQ ID NO: 2375 (IR-028), SEQ ID NO: 2379 (IR-029), SEQ ID NO: 2383 (IR-030), SEQ ID NO: 2387 (IR-031), SEQ ID NO: 2391 (IR-032), SEQ ID NO: 2395 (IR-033), SEQ ID NO: 2399 (IR-034), SEQ ID NO: 2403 (IR-035), SEQ ID NO: 2407 (IR-036), SEQ ID NO: 2411 (IR-037), SEQ ID NO: 2415 (IR-038), SEQ ID NO: 2419 (IR-039), SEQ ID NO: 2423 (IR-040), SEQ ID NO: 2427 (IR-041), SEQ ID NO: 2431 (IR-043), SEQ ID NO: 2435 (IR-044), SEQ ID NO: 2439 (IR-045), SEQ ID NO: 2443 (IR-046), SEQ ID NO: 2447 (IR-048), SEQ ID NO: 2451 (IR-049), SEQ ID NO: 2455 (IR-050), SEQ ID NO: 2459 (IR-051), SEQ ID NO: 2463 (IR-052), SEQ ID NO: 2467 (IR-053), SEQ ID NO: 2471 (IR-054), SEQ ID NO: 2475 (IR-055), SEQ ID NO: 2479 (IR-056), SEQ ID NO: 2483 (IR-057), SEQ ID NO: 2487 (IR-058), SEQ ID NO: 2491 (IR-059), SEQ ID NO: 2495 (IR-060), SEQ ID NO: 2499 (IR-061), SEQ ID NO: 2503 (IR-062), SEQ ID NO: 2507 (IR-063), SEQ ID NO: 2511 (IR-064), SEQ ID NO: 2515 (IR-065), SEQ ID NO: 2519 (IR-066), SEQ ID NO: 2523 (IR-067), SEQ ID NO: 2527 (IR-068), SEQ ID NO: 2531 (IR-069), SEQ ID NO: 2535 (IR-070), SEQ ID NO: 2539 (IR-071), SEQ ID NO: 2543 (IR-072), SEQ ID NO: 2547 (IR-073), SEQ ID NO: 2551 (IR-074), SEQ ID NO: 2555 (IR-075), SEQ ID NO: 2559 (IR-076), SEQ ID NO: 2563 (IR-077), SEQ ID NO: 2567 (IR-078), SEQ ID NO: 2571 (IR-079), SEQ ID NO: 2575 (IR-080), SEQ ID NO: 2579 (IR-081), SEQ ID NO: 2583 (IR-082), SEQ ID NO: 2587 (IR-083), SEQ ID NO: 2591 (IR-084), SEQ ID NO: 2595 (IR-085), SEQ ID NO: 2599 (IR-086), SEQ ID NO: 2603 (IR-087), SEQ ID NO: 2607 (IR-088), SEQ ID NO: 2611 (IR-089), SEQ ID NO: 2615 (IR-090), SEQ ID NO: 2619 (IR-092), SEQ ID NO: 2623 (IR-093), SEQ ID NO: 2627 (IR-094), SEQ ID NO: 2631 (IR-095), SEQ ID NO: 2635 (IR-097), SEQ ID NO: 2639 (IR-098), SEQ ID NO: 2643 (IR-100), SEQ ID NO: 2647 (IR-101), SEQ ID NO: 2651 (IR-102), SEQ ID NO: 2655 (IR-104), SEQ ID NO: 2659 (IR-105), SEQ ID NO: 2663 (IR-106), SEQ ID NO: 2667 (IR-107), SEQ ID NO: 2671 (IR-108), SEQ ID NO: 2675 (IR-109), SEQ ID NO: 2679 (IR-110), SEQ ID NO: 2683 (IR-112), SEQ ID NO: 2687 (IR-114), SEQ ID NO: 2691 (IR-115), SEQ ID NO: 2695 (IR-116), SEQ ID NO: 2699 (IR-117), SEQ ID NO: 2703 (IR-118), SEQ ID NO: 2707 (IR-119), SEQ ID NO: 2711 (IR-120), SEQ ID NO: 2715 (IR-121), SEQ ID NO: 2719 (IR-122), SEQ ID NO: 2723 (IR-123), SEQ ID NO: 2727 (IR-124), SEQ ID NO: 2731 (IR-125), SEQ ID NO: 2735 (IR-126), SEQ ID NO: 2739 (IR-127), SEQ ID NO: 2743 (IR-128), SEQ ID NO: 2747 (IR-129), SEQ ID NO: 2751 (IR-131), SEQ ID NO: 2755 (IR-132), SEQ ID NO: 2759 (IR-133), SEQ ID NO: 2763 (IR-134), SEQ ID NO: 2767 (IR-135), SEQ ID NO: 2771 (IR-136), SEQ ID NO: 2775 (IR-137), SEQ ID NO: 2779 (IR-138), SEQ ID NO: 2783 (IR-139), SEQ ID NO: 2787 (IR-140), SEQ ID NO: 2791 (IR-141), SEQ ID NO: 2795 (IR-142), SEQ ID NO: 2799 (IR-143), SEQ ID NO: 2803 (IR-144), SEQ ID NO: 2807 (IR-145), SEQ ID NO: 2811 (IR-146), SEQ ID NO: 2815 (IR-147), SEQ ID NO: 2819 (IR-149), SEQ ID NO: 2823 (IR-150), SEQ ID NO: 2827 (IR-151), SEQ ID NO: 2831 (IR-152), SEQ ID NO: 2835 (IR-153), SEQ ID NO: 2839 (IR-154), SEQ ID NO: 2843 (IR-155), SEQ ID NO: 2847 (IR-156), SEQ ID NO: 2851 (IR-157), SEQ ID NO: 2855 (IR-158), SEQ ID NO: 2859 (IR-159), SEQ ID NO: 2863 (IR-160), and SEQ ID NO: 2879 (IR-161).

The amino acid sequences of H-chain signal peptides of each antibody are shown in the following sequence ID numbers:

SEQ ID NO: 2894 (IR-002), SEQ ID NO: 2897 (IR-004, IR-006, IR-017, IR-023, IR-051, IR-055, IR-059, IR-074, IR-106, IR-116, IR-120, IR-126, IR-147, IR-150), SEQ ID NO: 2900 (IR-005, IR-007, IR-008, IR-012, IR-013, IR-014, IR-015, IR-020, IR-021, IR-025, IR-029, IR-031, IR-036, IR-038, IR-039, IR-041, IR-043, IR-044, IR-046, IR-049, IR-052, IR-064, IR-072, IR-080, IR-092, IR-095, IR-097, IR-098, IR-102, IR-104, IR-108, IR-109, IR-112, IR-117, IR-133, IR-141, IR-149, IR-153), SEQ ID NO: 2902 (IR-011, IR-026, IR-027, IR-028, IR-030, IR-037, IR-050, IR-053, IR-054, IR-056, IR-057, IR-058, IR-060, IR-061, IR-062, IR-063, IR-065, IR-067, IR-068, IR-069, IR-070, IR-071, IR-073, IR-075, IR-076, IR-077, IR-079, IR-081, IR-082, IR-083, IR-084, IR-085, IR-086, IR-089, IR-090, IR-093, IR-100, IR-101, IR-107, IR-110, IR-114, IR-115, IR-119, IR-121, IR-122, IR-123, IR-124, IR-125, IR-127, IR-128, IR-129, IR-132, IR-136, IR-137, IR-138, IR-139, IR-140, IR-143, IR-145, IR-146, IR-152, IR-154, IR-155, IR-157, IR-158, IR-160, IR-161), SEQ ID NO: 2904 (IR-022), SEQ ID NO: 2906 (IR-024), SEQ ID NO: 2909 (IR-032, IR-034, IR-040, IR-087), SEQ ID NO: 2911 (IR-033), SEQ ID NO: 2913 (IR-035), SEQ ID NO: 2915 (IR-045), SEQ ID NO: 2917 (IR-048), SEQ ID NO: 2919 (IR-066), SEQ ID NO: 2921 (IR-078, IR-135), SEQ ID NO: 2923 (IR-088), SEQ ID NO: 2925 (IR-094, IR-134), SEQ ID NO: 2927 (IR-105), SEQ ID NO: 2929 (IR-118), SEQ ID NO: 2931 (IR-131, IR-156), SEQ ID NO: 2933 (IR-142, IR-151), SEQ ID NO: 2935 (IR-144), and SEQ ID NO: 2937 (IR-159). The nucleotide sequences encoding H-chain signal peptides of each antibody are shown in the following sequence ID numbers:

SEQ ID NO: 2893 (IR-002), SEQ ID NO: 2895 (IR-004, IR-006, IR-017, IR-023, IR-051, IR-055, IR-059, IR-074, IR-106, IR-116, IR-126, IR-147, IR-150), SEQ ID NO: 2896 (IR-120), SEQ ID NO: 2898 (IR-005, IR-007, IR-020, IR-029, IR-031, IR-036, IR-038, IR-039, IR-041, IR-043, IR-046, IR-049, IR-064, IR-072, IR-080, IR-092, IR-095, IR-097, IR-098, IR-102, IR-104, IR-109, IR-117, IR-133, IR-141, IR-149), SEQ ID NO: 2899 (IR-008, IR-012, IR-013, IR-014, IR-015, IR-021, IR-025, IR-044, IR-052, IR-108, IR-112, IR-153), SEQ ID NO: 2901 (IR-011, IR-026, IR-027, IR-028, IR-030, IR-037, IR-050, IR-053, IR-054, IR-056, IR-057, IR-058, IR-060, IR-061, IR-062, IR-063, IR-065, IR-067, IR-068, IR-069, IR-070, IR-071, IR-073, IR-075, IR-076, IR-077, IR-079, IR-081, IR-082, IR-083, IR-084, IR-085, IR-086, IR-089, IR-090, IR-093, IR-100, IR-101, IR-107, IR-110, IR-114, IR-115, IR-119, IR-121, IR-122, IR-123, IR-124, IR-125, IR-127, IR-128, IR-129, IR-132, IR-136, IR-137, IR-138, IR-139, IR-140, IR-143, IR-145, IR-146, IR-152, IR-154, IR-155, IR-157, IR-158, IR-160, IR-161), SEQ ID NO: 2903 (IR-022), SEQ ID NO: 2905 (IR-024), SEQ ID NO: 2907 (IR-032, IR-034, IR-040), SEQ ID NO: 2908 (IR-087), SEQ ID NO: 2910 (IR-033), SEQ ID NO: 2912 (IR-035), SEQ ID NO: 2914 (IR-045), SEQ ID NO: 2916 (IR-048), SEQ ID NO: 2918 (IR-066), SEQ ID NO: 2920 (IR-078, IR-135), SEQ ID NO: 2922 (IR-088), SEQ ID NO: 2924 (IR-094, IR-134), SEQ ID NO: 2926 (IR-105), SEQ ID NO: 2928 (IR-118), SEQ ID NO: 2930 (IR-131, IR-156), SEQ ID NO: 2932 (IR-142, IR-151), SEQ ID NO: 2934 (IR-144), and SEQ ID NO: 2936 (IR-159).

The amino acid sequences of L-chain signal peptides of each antibody are shown in the following sequence ID numbers:

SEQ ID NO: 2939 (IR-001, IR-006, IR-008, IR-011, IR-012, IR-013, IR-024), SEQ ID NO: 2943 (IR-002, IR-004, IR-005, IR-007, IR-015, IR-017, IR-020, IR-021, IR-022, IR-025, IR-026, IR-027, IR-028, IR-029, IR-030, IR-031, IR-032, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-085, IR-086, IR-087, IR-089, IR-092, IR-093, IR-095, IR-097, IR-100, IR-101, IR-102, IR-104, IR-105, IR-106, IR-107, IR-108, IR-109, IR-110, IR-112, IR-114, IR-115, IR-116, IR-117, IR-118, IR-120, IR-121, IR-122, IR-123, IR-124, IR-125, IR-126, IR-127, IR-128, IR-129, IR-131, IR-132, IR-133, IR-135, IR-136, IR-137, IR-138, IR-139, IR-140, IR-141, IR-142, IR-143, IR-144, IR-145, IR-146, IR-147, IR-150, IR-151, IR-152, IR-153, IR-154, IR-155, IR-156, IR-157, IR-158, IR-159, IR-160), SEQ ID NO: 2945 (IR-014), SEQ ID NO: 2947 (IR-023), SEQ ID NO: 2949 (IR-033), SEQ ID NO: 2951 (IR-088, IR-134), SEQ ID NO: 2953 (IR-090), SEQ ID NO: 2955 (IR-094), SEQ ID NO: 2957 (IR-098), SEQ ID NO: 2959 (IR-119), SEQ ID NO: 2961 (IR-149), and SEQ ID NO: 2963 (IR-161).

The nucleotide sequences encoding L-chain signal peptides of each antibody are shown in the following sequence ID numbers:

SEQ ID NO: 2938 (IR-001, IR-006, IR-008, IR-011, IR-012, IR-013, IR-024), SEQ ID NO: 2940 (IR-002, IR-004, IR-005, IR-007, IR-015, IR-017, IR-020, IR-021, IR-022, IR-025, IR-026, IR-027, IR-028, IR-029, IR-030, IR-031, IR-032, IR-034, IR-035, IR-036, IR-037, IR-038, IR-039, IR-040, IR-041, IR-043, IR-044, IR-045, IR-046, IR-048, IR-049, IR-050, IR-051, IR-052, IR-053, IR-054, IR-055, IR-056, IR-057, IR-058, IR-059, IR-060, IR-061, IR-062, IR-063, IR-064, IR-065, IR-066, IR-067, IR-068, IR-069, IR-070, IR-071, IR-072, IR-073, IR-074, IR-075, IR-076, IR-077, IR-078, IR-079, IR-080, IR-081, IR-082, IR-083, IR-084, IR-086, IR-087, IR-089, IR-092, IR-093, IR-095, IR-097, IR-100, IR-101, IR-102, IR-104, IR-105, IR-106, IR-107, IR-108, IR-109, IR-110, IR-112, IR-114, IR-115, IR-116, IR-117, IR-118, IR-120, IR-121, IR-122, IR-123, IR-124, IR-125, IR-126, IR-127, IR-128, IR-131, IR-132, IR-133, IR-135, IR-136, IR-137, IR-138, IR-139, IR-140, IR-141, IR-142, IR-143, IR-144, IR-145, IR-146, IR-147, IR-150, IR-151, IR-152, IR-153, IR-154, IR-155, IR-156, IR-157, IR-158, IR-159, IR-160), SEQ ID NO: 2941 (IR-085), SEQ ID NO: 2942 (IR-129), SEQ ID NO: 2944 (IR-014), SEQ ID NO: 2946 (IR-023), SEQ ID NO: 2948 (IR-033), SEQ ID NO: 2950 (IR-088, IR-134), SEQ ID NO: 2952 (IR-090), SEQ ID NO: 2954 (IR-094), SEQ ID NO: 2956 (IR-098), SEQ ID NO: 2958 (IR-119), SEQ ID NO: 2960 (IR-149), and SEQ ID NO: 2962 (IR-161).

Competitive ELISA Analysis

Figures 2, 3:
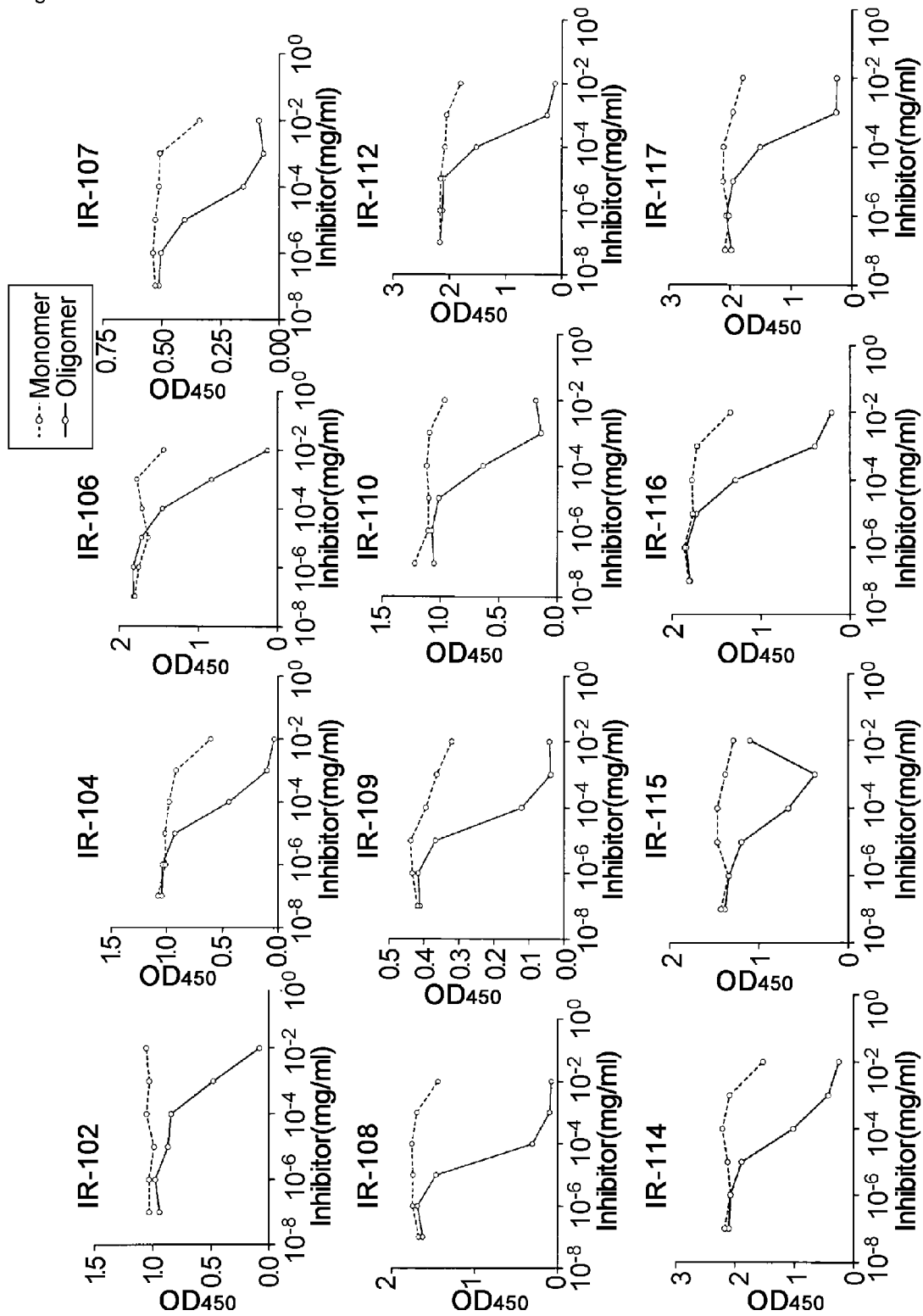

Dot blot analysis is a method for analyzing a reactivity against A beta monomer or oligomer immobilized onto nitrocellulose membrane. However, A betas are solubilized into fluids such as interstitial fluid, cerebral fluid, or blood. Then, the present analysis was carried out for investigating specific binding to A beta oligomers in solutions and difference of selectivity to A beta monomer. Competitive ELISA is a method for determining oligomer specificity by preliminarily reacting with antibodies to be measured and serially-diluted A beta monomer or oligomer in solutions, and carrying out ELISA by adding the solutions to a plate immobilized with A beta oligomer. When an antibody is an A beta oligomer-specific antibody, ELISA reaction decreases in an A beta oligomer concentration-dependent manner in a solution reacted with A beta oligomer, but does not decrease in a solution reacted with A beta monomer or decreases when A beta concentration becomes higher than the oligomer concentration. 130 antibodies were analyzed and the result shown in FIG. 2 was obtained. The 129 antibodies except for IR-088 showed high binding specificity even in the solution. Meanwhile, antibody that react with both A beta monomer and oligomer (6E10) used as a control showed equivalent ELISA reactivity against monomer and oligomer. Furthermore, the competitive ELISA results in which the inhibitor concentration is shown as molar concentration are shown in FIG. 3. $IC_{50}$ and A beta oligomer selectivity over A beta monomer (A beta monomer $IC_{50}$/A beta oligomer $IC_{50}$) calculated by the competitive ELISA in FIG. 3 are shown in Table 2.

TABLE 2

| Antibody Name | $IC_{50}$(nmol/L) monomer | $IC_{50}$(nmol/L) oligomer | Selectivity (vs monomer) |
|---|---|---|---|
| IR-004 | 1310 | 13.7 | 95.6 |
| IR-005 | >2200 | 10.3 | >213.6 |
| IR-006 | 632 | 11.0 | 57.5 |
| IR-008 | 1340 | 10.1 | 132.7 |
| IR-011 | >2200 | 17.1 | >128.7 |
| IR-012 | 1990 | 115.0 | 17.3 |
| IR-013 | 1860 | 2.9 | 641.4 |
| IR-014 | 1540 | 10.2 | 151.0 |
| IR-015 | 2120 | 27.6 | 76.8 |
| IR-017 | 1630 | 49.0 | 33.3 |
| IR-020 | >2200 | 8.81 | >249.7 |
| IR-021 | >2200 | 4.39 | >501.1 |
| IR-022 | >2200 | 135 | >16.3 |
| IR-023 | >2200 | 24.4 | >90.2 |
| IR-025 | >2200 | 27.5 | >80 |
| IR-026 | >2200 | 43.6 | >50.5 |
| IR-027 | >2200 | 82.7 | >26.6 |
| IR-028 | >2200 | 2.97 | >740.7 |
| IR-029 | >2200 | 308 | >7.1 |
| IR-030 | >2200 | 28.1 | >78.3 |
| IR-031 | >2200 | 4.47 | >492.2 |
| IR-032 | 2020 | 25.3 | 79.8 |
| IR-034 | 2020 | 22.6 | 89.4 |
| IR-036 | >2200 | 23 | >95.7 |
| IR-037 | >2200 | 22.5 | >97.8 |
| IR-038 | >2200 | 2.94 | >748.3 |
| IR-039 | >2200 | 17.2 | >127.9 |
| IR-040 | >2200 | 5.02 | >438.2 |
| IR-041 | >2200 | 38.3 | >57.4 |
| IR-043 | >2200 | 258 | >8.5 |
| IR-045 | >2200 | 673 | >3.3 |
| IR-046 | >2200 | 225 | >9.8 |
| IR-048 | >2200 | 369 | >6 |
| IR-049 | >2200 | 310 | >7.1 |
| IR-050 | >2200 | 29.2 | >75.3 |
| IR-051 | 264 | 6.04 | 43.7 |
| IR-052 | >2200 | 43.9 | >50.1 |
| IR-053 | >2200 | 291 | >7.6 |
| IR-056 | >2200 | 1.45 | >1517.2 |
| IR-057 | >2200 | 19.5 | >112.8 |
| IR-058 | >2200 | 9.34 | >235.5 |
| IR-060 | >2200 | 2.57 | >856 |
| IR-061 | >2200 | 47.1 | >46.7 |
| IR-062 | >2200 | 2.56 | >859.4 |
| IR-063 | >2200 | 4.98 | >441.8 |
| IR-064 | >2200 | 13.7 | >160.6 |
| IR-066 | >2200 | 80.2 | >27.4 |
| IR-067 | >2200 | 5.07 | >433.9 |
| IR-069 | >2200 | 7.25 | >303.4 |
| IR-070 | >2200 | 3.59 | >612.8 |
| IR-073 | >2200 | 32.3 | >68.1 |
| IR-074 | >2200 | 14.1 | >156 |
| IR-075 | >2200 | 8.71 | >252.6 |
| IR-076 | >2200 | 11.5 | >191.3 |
| IR-077 | >2200 | 2.76 | >797.1 |
| IR-078 | >2200 | 4.29 | >512.8 |
| IR-079 | >2200 | 6.98 | >315.2 |
| IR-080 | >2200 | 71.7 | >30.7 |
| IR-081 | >2200 | 16.5 | >133.3 |
| IR-082 | >2200 | 3.25 | >676.9 |
| IR-083 | >2200 | 11.5 | >189.7 |
| IR-084 | >2200 | 4.49 | >490 |
| IR-086 | >2200 | 5.29 | >415.9 |
| IR-087 | >2200 | 17.9 | >122.9 |
| IR-088 | 558 | 418 | 1.3 |
| IR-089 | >2200 | 35.3 | >62.3 |
| IR-090 | >2200 | 6.36 | >345.9 |
| IR-092 | >2200 | 88.7 | >24.8 |
| IR-093 | 1088 | 5.58 | 195.0 |
| IR-094 | >2200 | 37.5 | >58.7 |
| IR-095 | >2200 | 15.7 | >140.1 |
| IR-097 | >2200 | 9.92 | >221.8 |
| IR-098 | >2200 | 40.6 | >54.2 |
| IR-100 | >2200 | 11.6 | >189.7 |
| IR-101 | 1910 | 6.93 | 275.6 |
| IR-102 | >2200 | 209 | >10.5 |
| IR-104 | >2200 | 15.4 | >142.9 |
| IR-105 | >2200 | 9.16 | >240.2 |
| IR-106 | >2200 | 146 | >15.1 |
| IR-107 | >2200 | 3.57 | >616.2 |
| IR-108 | >2200 | 2.59 | >849.4 |
| IR-109 | >2200 | 18.8 | >117 |
| IR-110 | >2200 | 4.82 | >456.4 |
| IR-112 | >2200 | 3.9 | >564.1 |
| IR-114 | >2200 | 15.9 | >138.4 |
| IR-115 | >2200 | 31.7 | >69.4 |
| IR-116 | >2200 | 42 | >52.4 |
| IR-117 | >2200 | 12.7 | >173.2 |
| IR-118 | >2200 | 3.56 | >61.8 |
| IR-119 | >2200 | 66.5 | >33.1 |
| IR-120 | >2200 | 2.74 | >802.9 |
| IR-121 | >2200 | 5.32 | >413.5 |
| IR-122 | 1411 | 8.18 | 172.5 |
| IR-123 | 659 | 1.04 | 633.7 |
| IR-124 | >2200 | 17.3 | >127.2 |
| IR-125 | >2200 | 18.2 | >1203 |
| IR-126 | >2200 | 34.1 | >64.5 |
| IR-127 | >2200 | 13.4 | >164.2 |
| IR-128 | >2200 | 4.23 | >520.1 |
| IR-129 | >2200 | 17.5 | >125.7 |
| IR-131 | >2200 | 78.9 | >27.9 |
| IR-132 | >2200 | 12.1 | >181.8 |
| IR-133 | >2200 | 18 | >122.2 |
| IR-134 | >2200 | 13.1 | >167.9 |
| IR-135 | >2200 | 10.9 | >201.8 |
| IR-136 | >2200 | 8.35 | >263.5 |
| IR-137 | >2200 | 8.47 | >259.7 |
| IR-138 | >2200 | 20.6 | >106.8 |
| IR-139 | >2200 | 4.43 | >496.6 |
| IR-140 | >2200 | 7.44 | >295.7 |
| IR-141 | 2120 | 20.2 | 105.0 |
| IR-142 | >2200 | 6.74 | >326.4 |
| IR-143 | >2200 | 5.71 | >385.3 |
| IR-144 | >2200 | 9.59 | >229.4 |
| IR-145 | >2200 | 31.1 | >70.7 |
| IR-146 | >2200 | 5.12 | >429.7 |
| IR-147 | >2200 | 139 | >15.8 |
| IR-149 | >2200 | 35.5 | >62 |
| IR-150 | >2200 | 6.71 | >327.9 |
| IR-151 | >2200 | 119 | >18.5 |
| IR-152 | >2200 | 31.5 | >69.8 |
| IR-153 | >2200 | 58.7 | >37.5 |
| IR-154 | >2200 | 3.54 | >621.5 |
| IR-155 | >2200 | 3.61 | >609.4 |
| IR-156 | >2200 | 14.6 | >150.7 |
| IR-157 | >2200 | 7.91 | >278.1 |
| IR-158 | >2200 | 232 | >9.5 |
| IR-159 | >2200 | 912 | >2.4 |
| IR-160 | >2200 | 4.65 | >473.1 |
| IR-161 | >2200 | 12.9 | >170.5 |
| Control (6E10) | 6.84 | 7.58 | 0.9 |

Analysis of Affinity for A Beta Oligomer

Figures 2, 3, 4, 5:
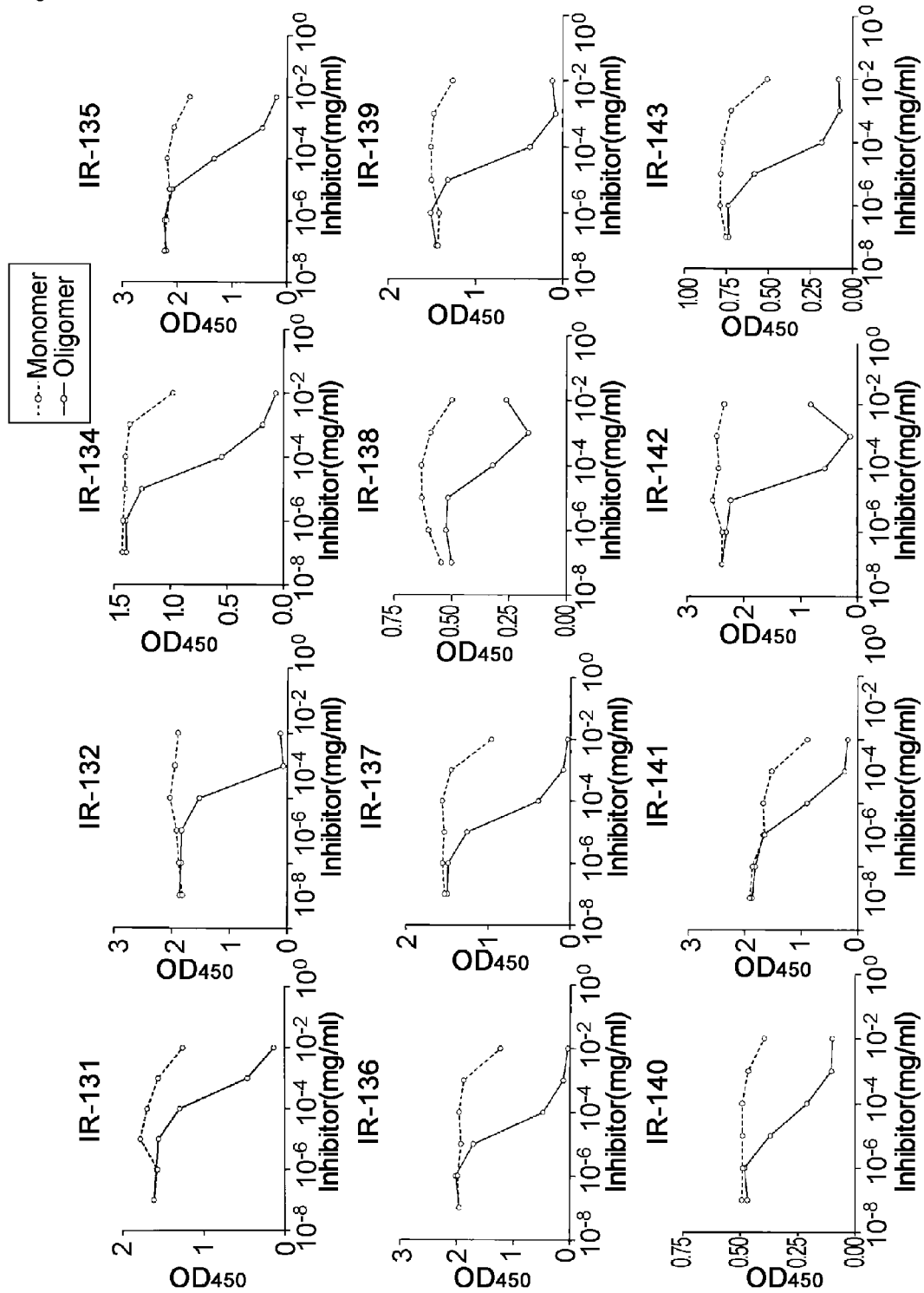

To investigate the binding ability of the antibodies of the present invention to A beta oligomer, affinity was analyzed (see Methods). 41 antibodies were analyzed and results shown in FIG. 4 were obtained. Calculated association rate constant (ka), dissociation rate constant (kd), and dissociation constant (KD) was shown in Table 3.

TABLE 3

| Antibody | Kinetics assay | | |
| --- | --- | --- | --- |
| Name | ka ($M^{-1}s^{-1}$) | kd ($s^{-1}$) | KD = kd/ka (M) |
| IR-028 | 3.17E+05 | 0.27 | 8.52E−07 |
| IR-036 | 8.76E+04 | 8.76E−03 | 1.00E−07 |
| IR-037 | 9.24E+04 | 0.0609 | 6.59E−07 |
| IR-038 | 8.92E+04 | 7.52E−03 | 8.43E−08 |
| IR-039 | 1.50E+05 | 7.11E−03 | 4.74E−08 |
| IR-041 | 6.94E+04 | 0.0949 | 1.37E−06 |
| IR-056 | 3.26E+05 | 0.141 | 4.33E−07 |
| IR-057 | 3.70E+05 | 5.79E−02 | 1.56E−07 |
| IR-060 | 7.67E+04 | 0.2 | 2.61E−06 |
| IR-062 | 3.82E+05 | 1.39E−01 | 3.64E−07 |
| IR-063 | 1.14E+05 | 0.145 | 1.27E−06 |
| IR-067 | 2.15E+05 | 0.118 | 5.49E−07 |
| IR-077 | 2.78E+05 | 0.153 | 5.50E−07 |
| IR-079 | 2.82E+05 | 0.297 | 1.05E−06 |
| IR-081 | 3.36E+05 | 0.421 | 1.25E−06 |
| IR-083 | 6.17E+05 | 0.431 | 6.99E−07 |
| IR-084 | 3.35E+05 | 0.201 | 6.00E−07 |
| IR-086 | 2.33E+05 | 0.28 | 1.20E−06 |
| IR-094 | 3.62E+05 | 0.0215 | 5.94E−08 |
| IR-095 | 9.46E+04 | 3.31E−03 | 3.50E−08 |
| IR-097 | 1.93E+05 | 3.03E−03 | 1.57E−08 |
| IR-098 | 3.80E+05 | 0.0138 | 3.63E−08 |
| IR-107 | 2.95E+05 | 0.1 | 3.39E−07 |
| IR-108 | 2.50E+05 | 2.96E−03 | 1.18E−08 |
| IR-110 | 4.07E+05 | 0.0719 | 1.77E−07 |
| IR-112 | 9.14E+04 | 3.76E−03 | 4.11E−08 |
| IR-117 | 7.25E+04 | 0.0668 | 9.21E−07 |
| IR-118 | 5.57E+04 | 1.53E−03 | 2.75E−08 |
| IR-121 | 9.87E+04 | 8.31E−03 | 8.42E−08 |
| IR-124 | 7.04E+04 | 9.95E−03 | 1.41E−07 |
| IR-125 | 5.01E+04 | 3.95E−03 | 7.88E−08 |
| IR-127 | 2.56E+05 | 0.261 | 1.02E−06 |
| IR-128 | 3.45E+05 | 0.37 | 1.07E−06 |
| IR-132 | 2.34E+05 | 5.17E−03 | 2.21E−08 |
| IR-135 | 8.99E+04 | 0.116 | 1.29E−06 |
| IR-139 | 3.26E+04 | 1.65E−03 | 5.06E−08 |
| IR-146 | 3.61E+05 | 0.383 | 1.06E−06 |
| IR-150 | 2.40E+05 | 0.124 | 5.17E−07 |
| IR-152 | 3.86E+04 | 2.27E−03 | 5.88E−08 |
| IR-154 | 3.89E+05 | 0.41 | 1.05E−06 |
| IR-155 | 3.51E+05 | 0.37 | 1.05E−06 |
| 6E10 | 5.78E+04 | 1.68E−04 | 2.91E−09 |

Assay of the Neutralization Ability of the Anti-A Beta Oligomer Antibodies Against A Beta-Induced Cytotoxicity A beta oligomers cause cytotoxicity to neuronal cells. To assess whether the anti-A beta oligomer antibodies of the present invention neutralize A beta-induced cytotoxicity, in vitro assay using human neuroblastoma cells (SH-SY5Y cells) was performed. Most of the antibodies showed the neutralization ability against A beta-induced cytotoxicity. Examples of the antibodies showing the neutralization ability are shown in FIG. 5. In the graphs, the value of Y axis indicates the relative rate to the cytotoxicity of A beta only (no antibody).

Figures 2, 3, 4, 5, 6:
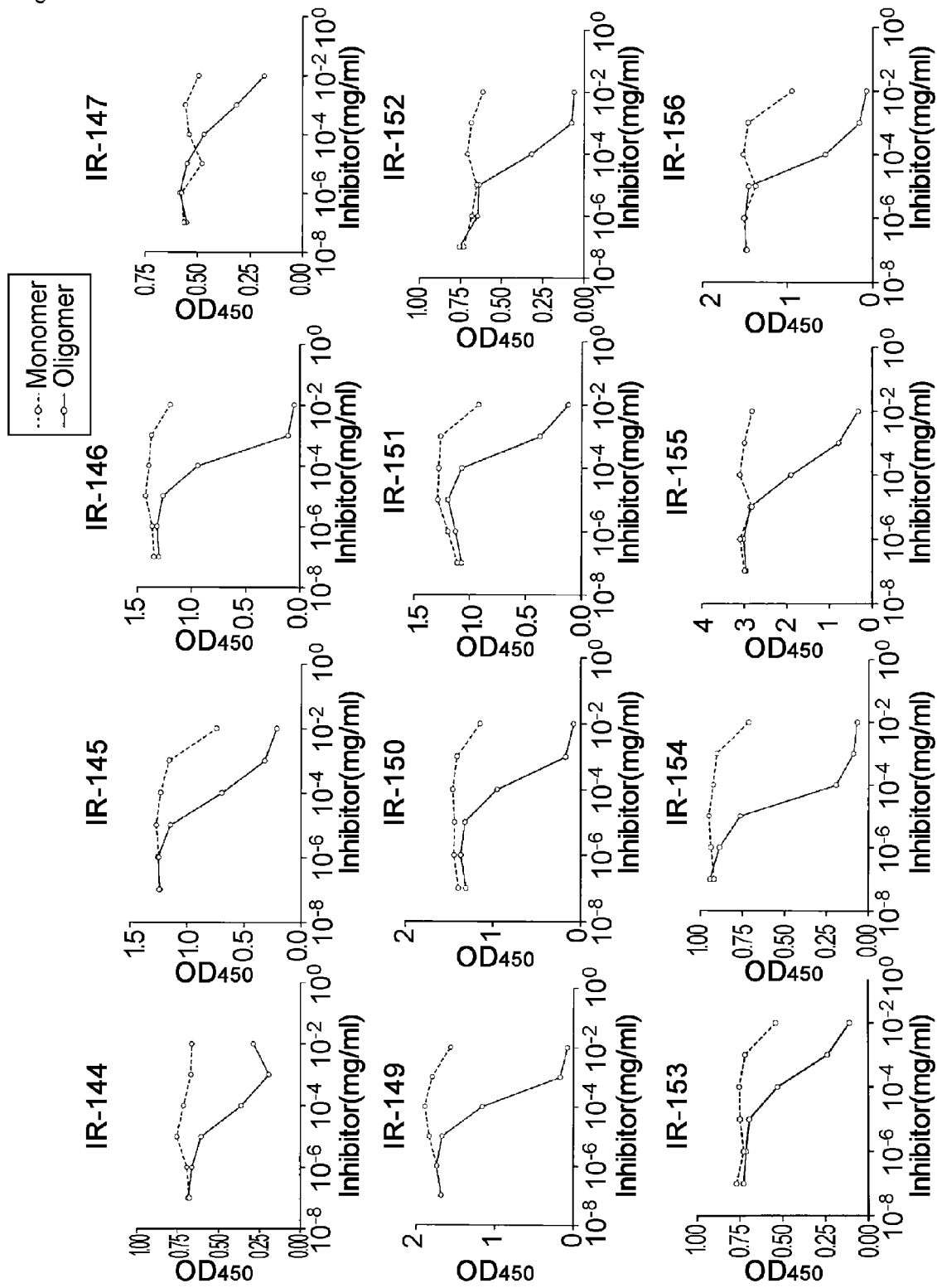

Assay of the Inhibition Ability of the Anti-A Beta Oligomer Antibodies Against A Beta-Fibril Formation A beta monomers form fibrils as a result of multimerization when they are incubated in a neutral pH buffer. To assess whether the antibodies of the present invention inhibit the fibril formation, an antibody and A beta were mixed and incubated for 24 hours and the mixture were measured by fluorescence of ThioflavinT which reflects the amount of fibrils. Most of the antibodies showed the inhibition ability against A beta fibril formation. Examples of the antibodies showing the inhibition ability are shown in FIG. 6. In the graph, the value of Y axis indicates the relative rate to the fibril formation of A beta only (no antibody).

Immunoblotting to Confirm that the Anti-A Beta Oligomer Antibodies do not Bind to APP (Amyloid Precursor Protein)

Figures 1, 3:
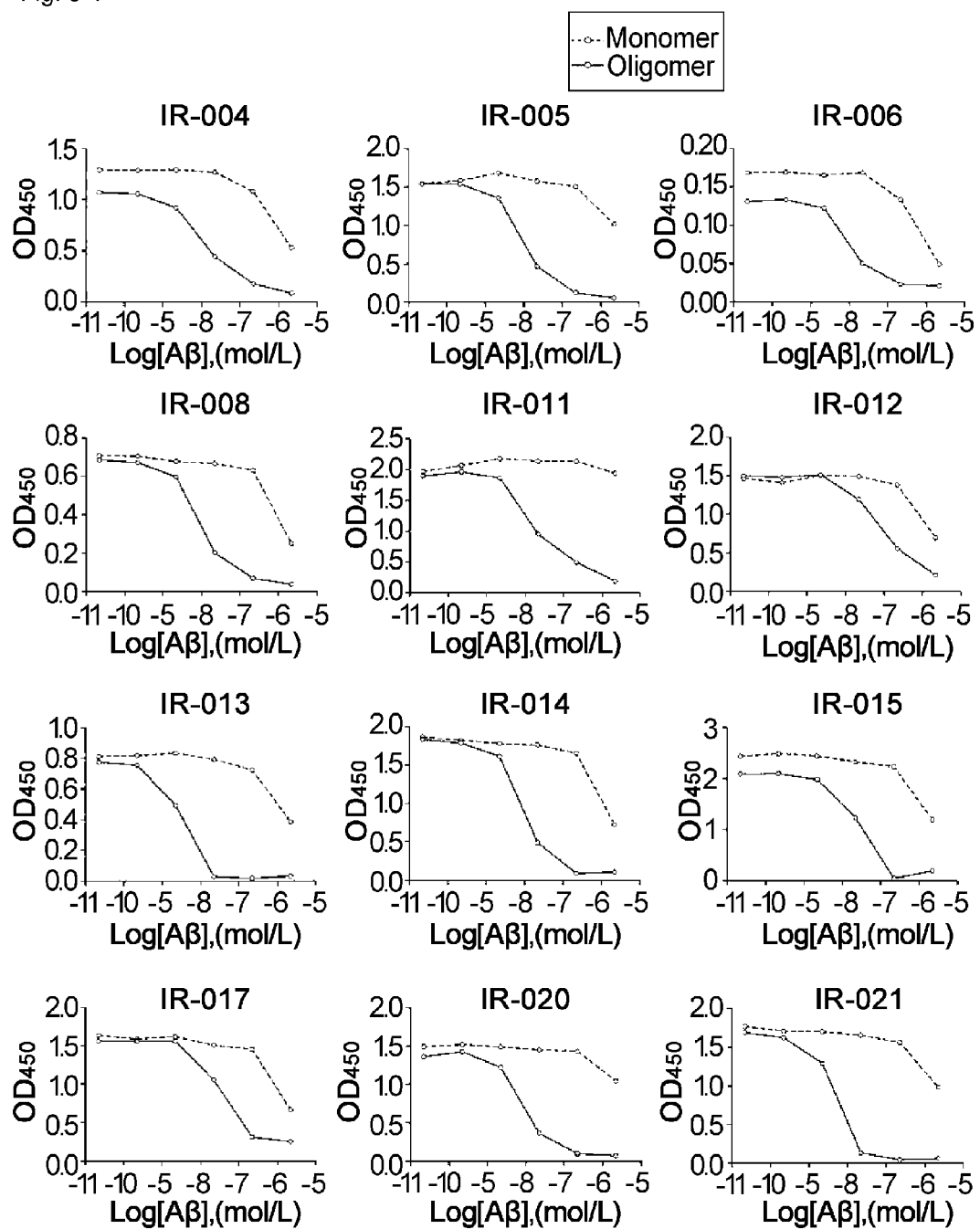
Figures 2, 3:
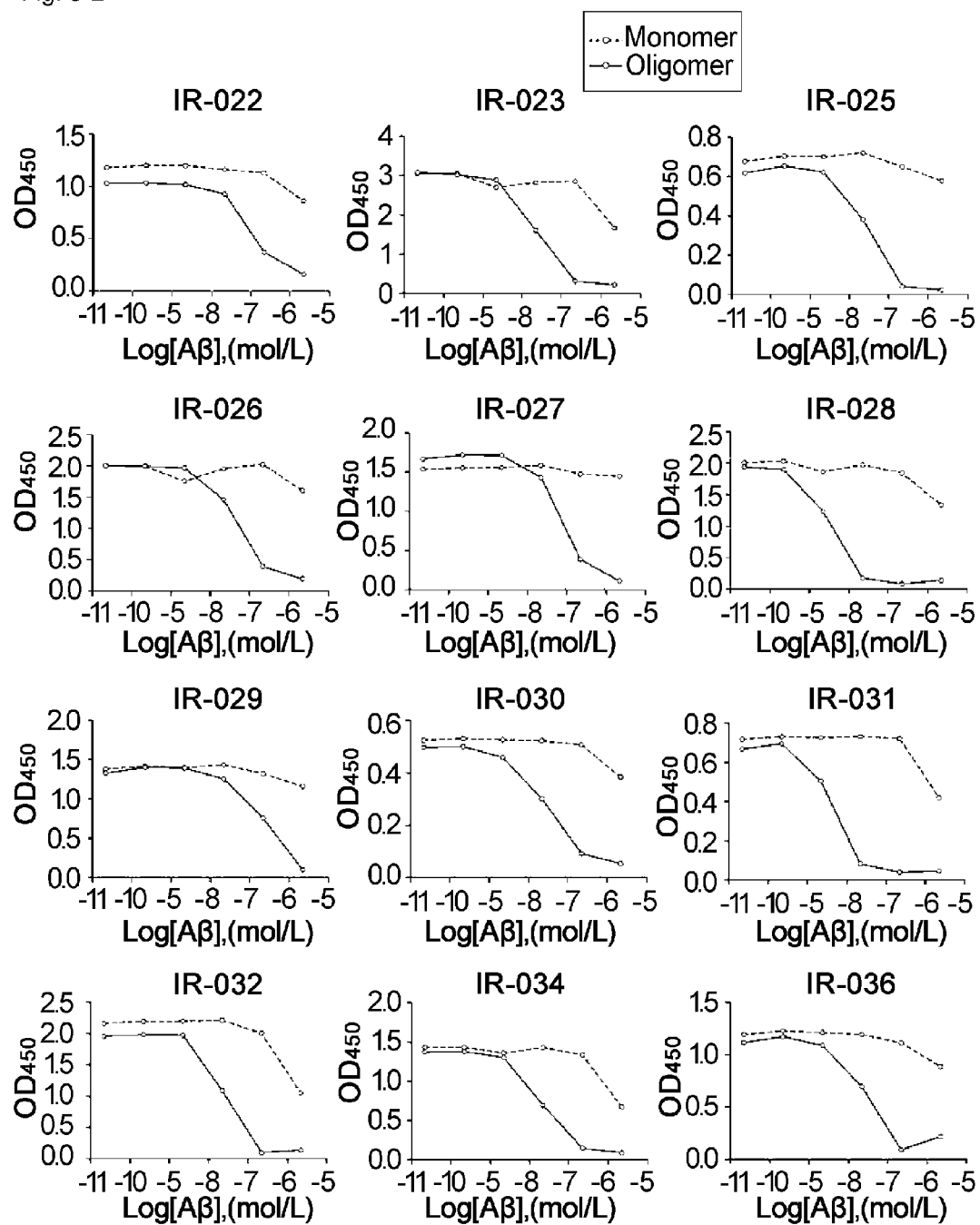
Figure 3:
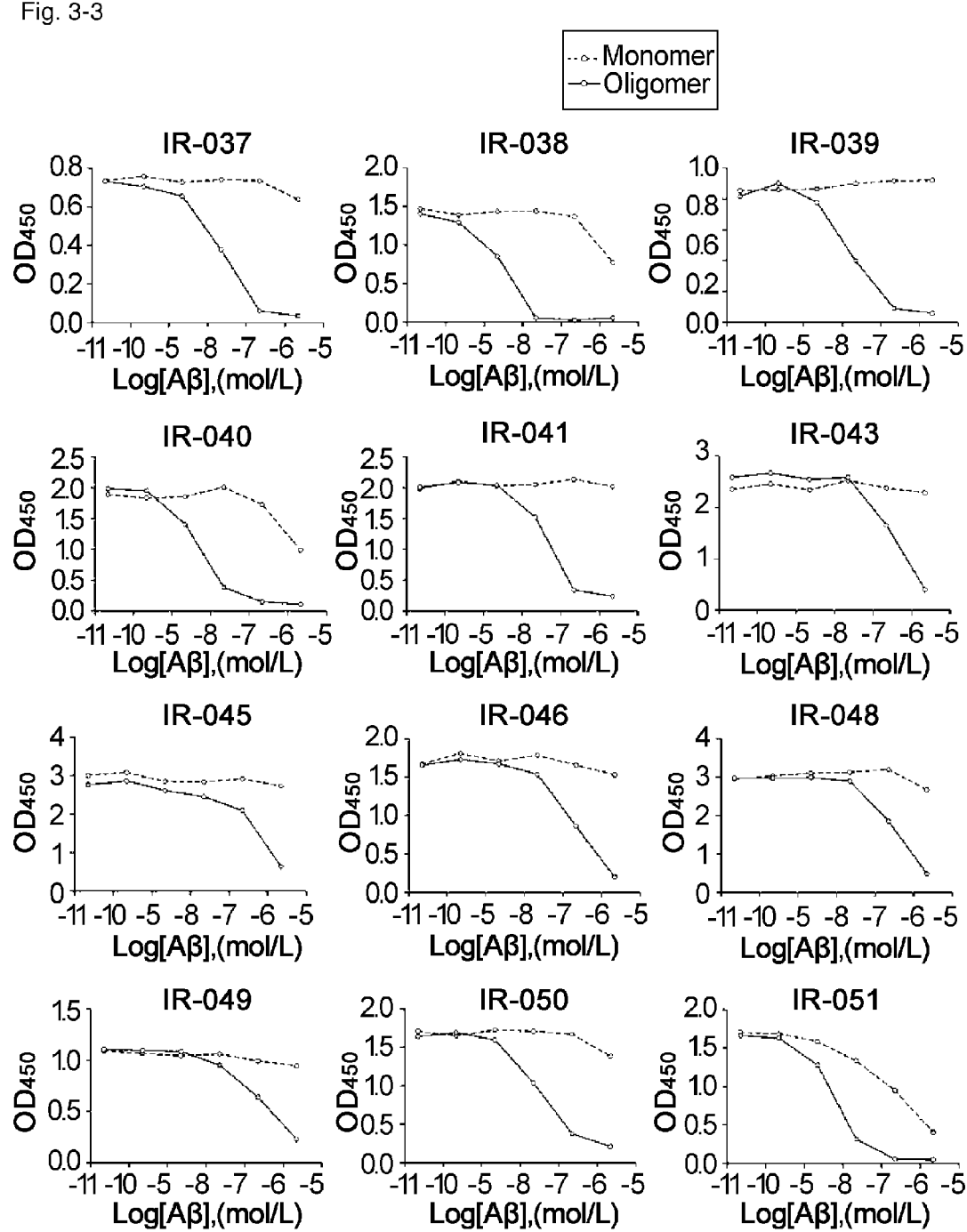
Figures 3, 4:
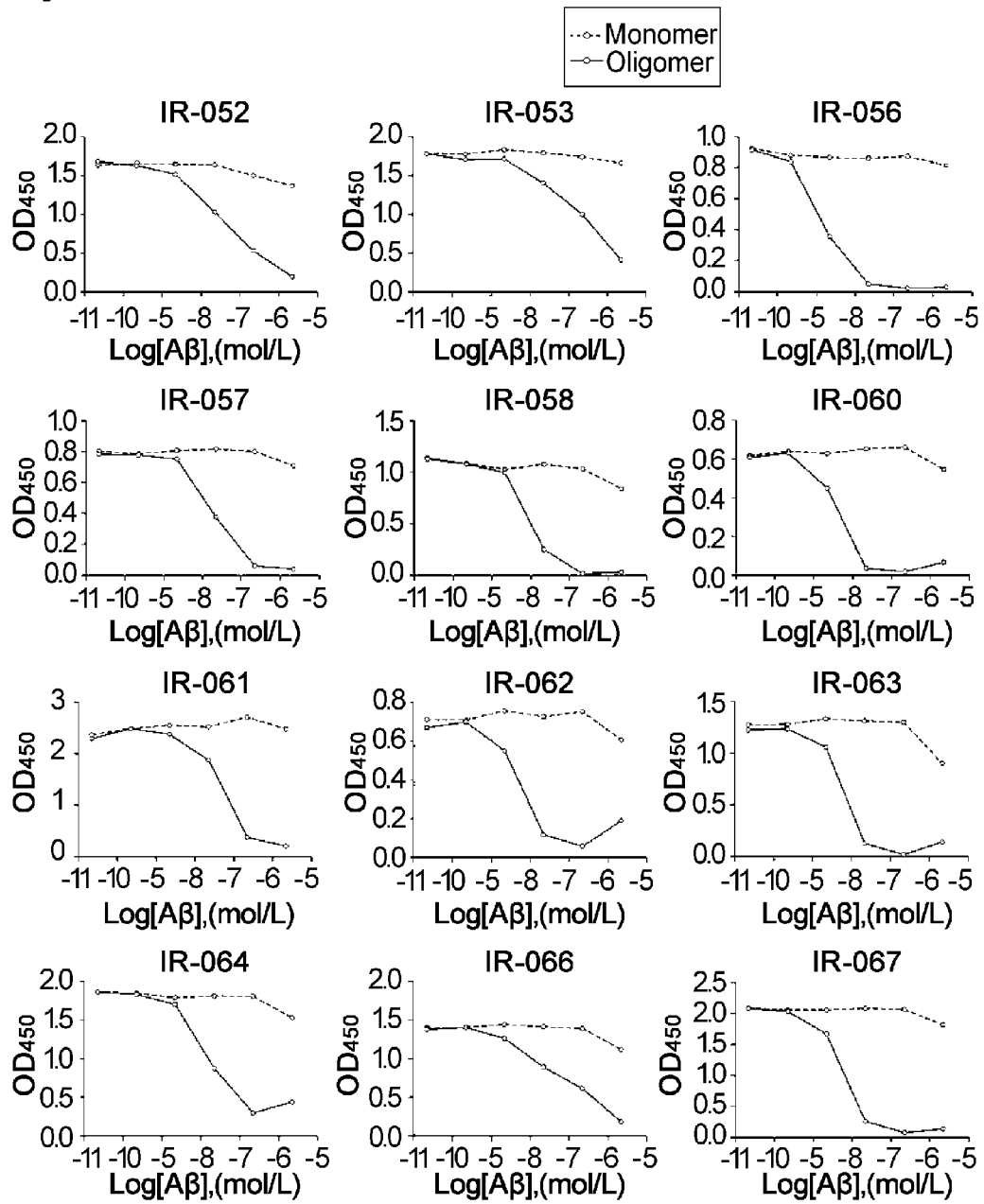
Figures 3, 4, 5:
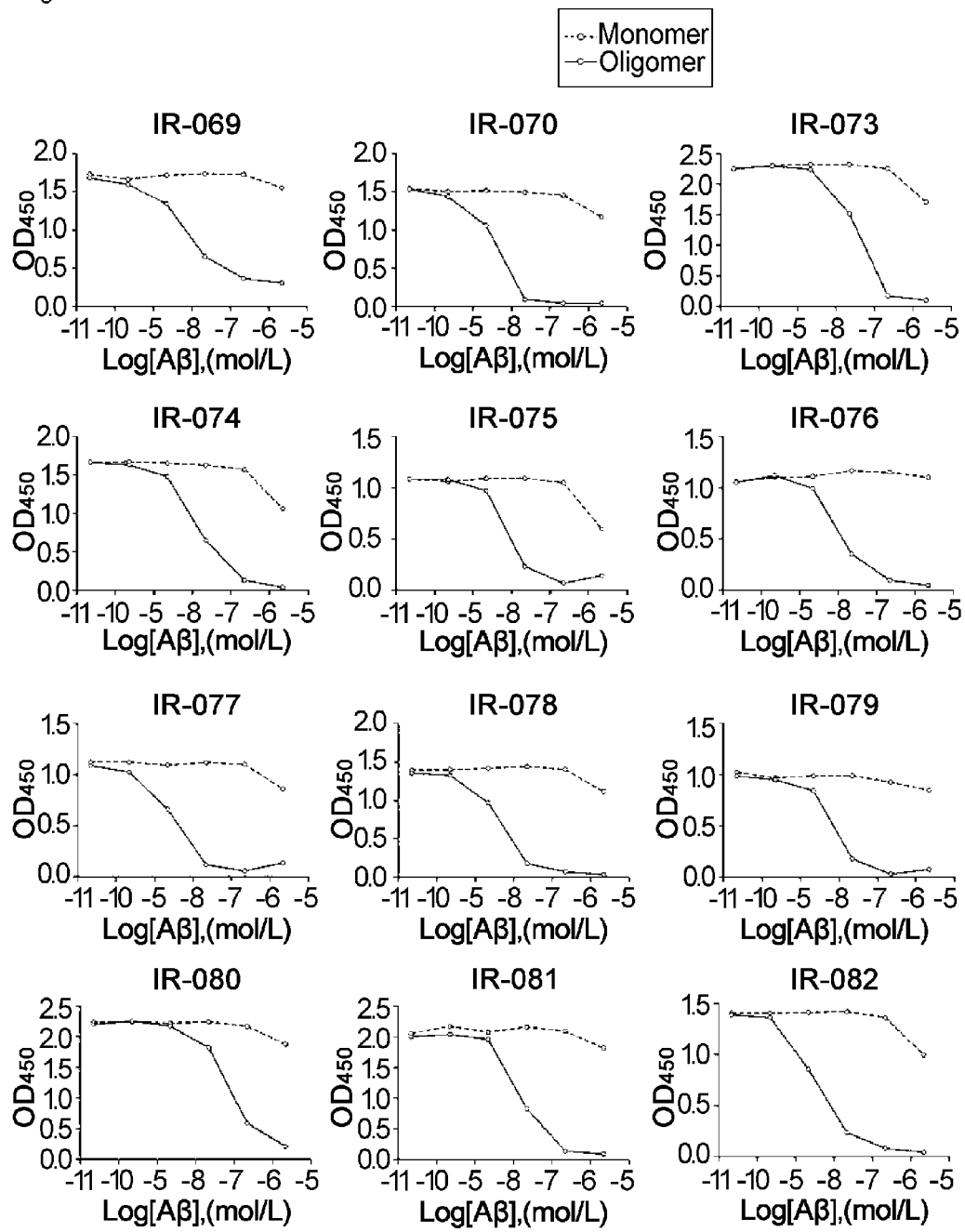
Figures 3, 4, 5, 6:
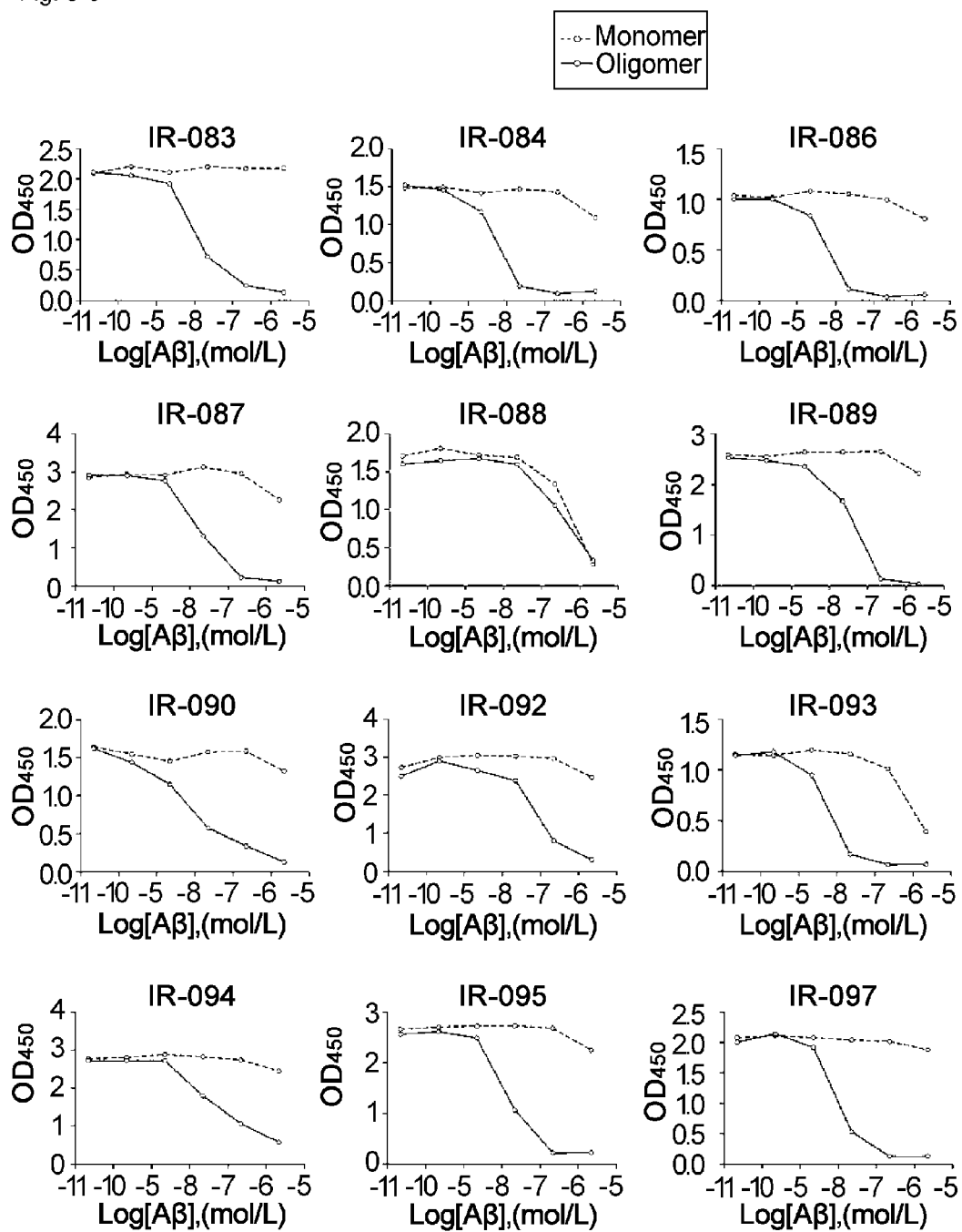
Figures 3, 4, 5, 6, 7:
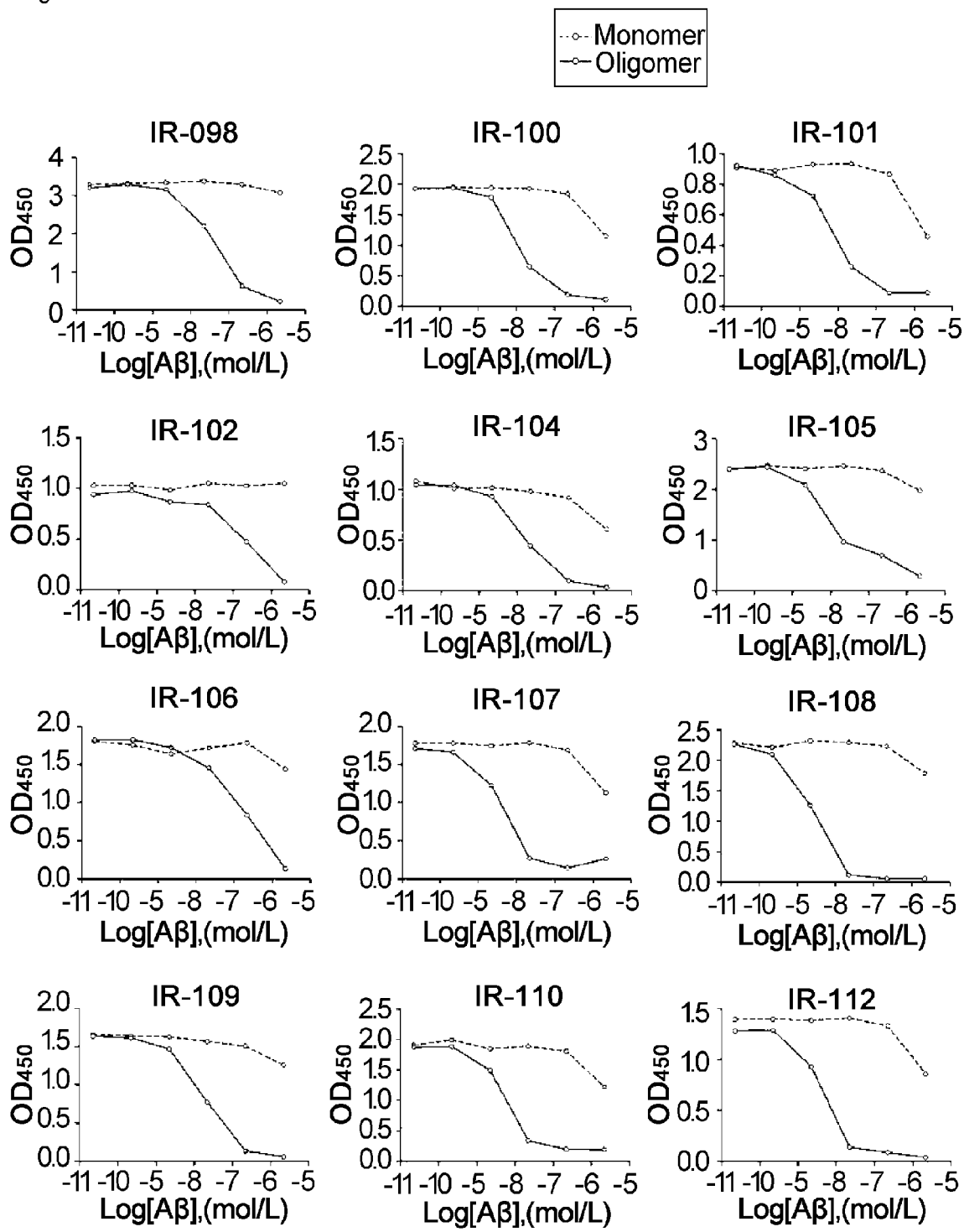
Figures 3, 4, 5, 6, 7, 8:
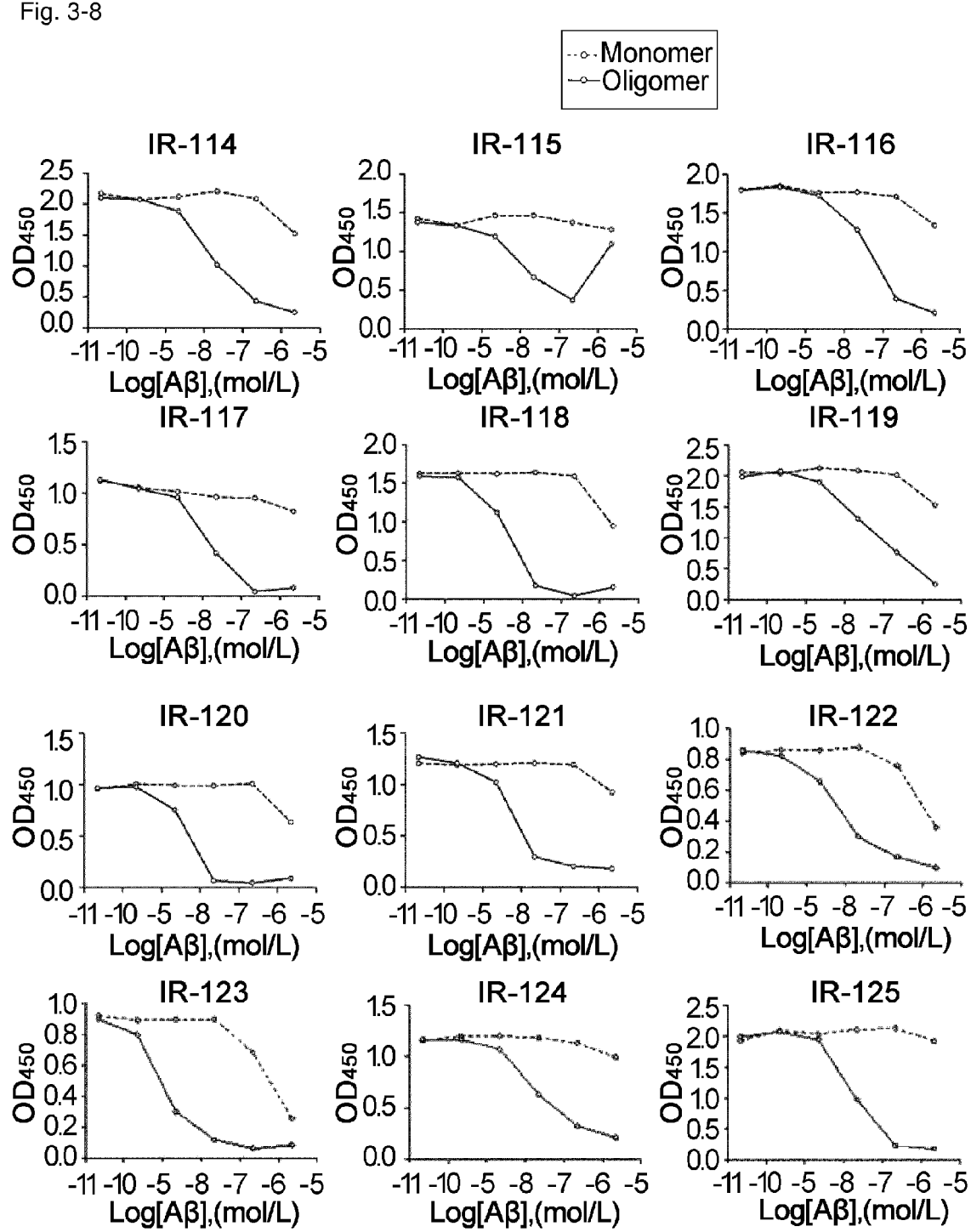
Figures 3, 4, 5, 6, 7, 8, 9:
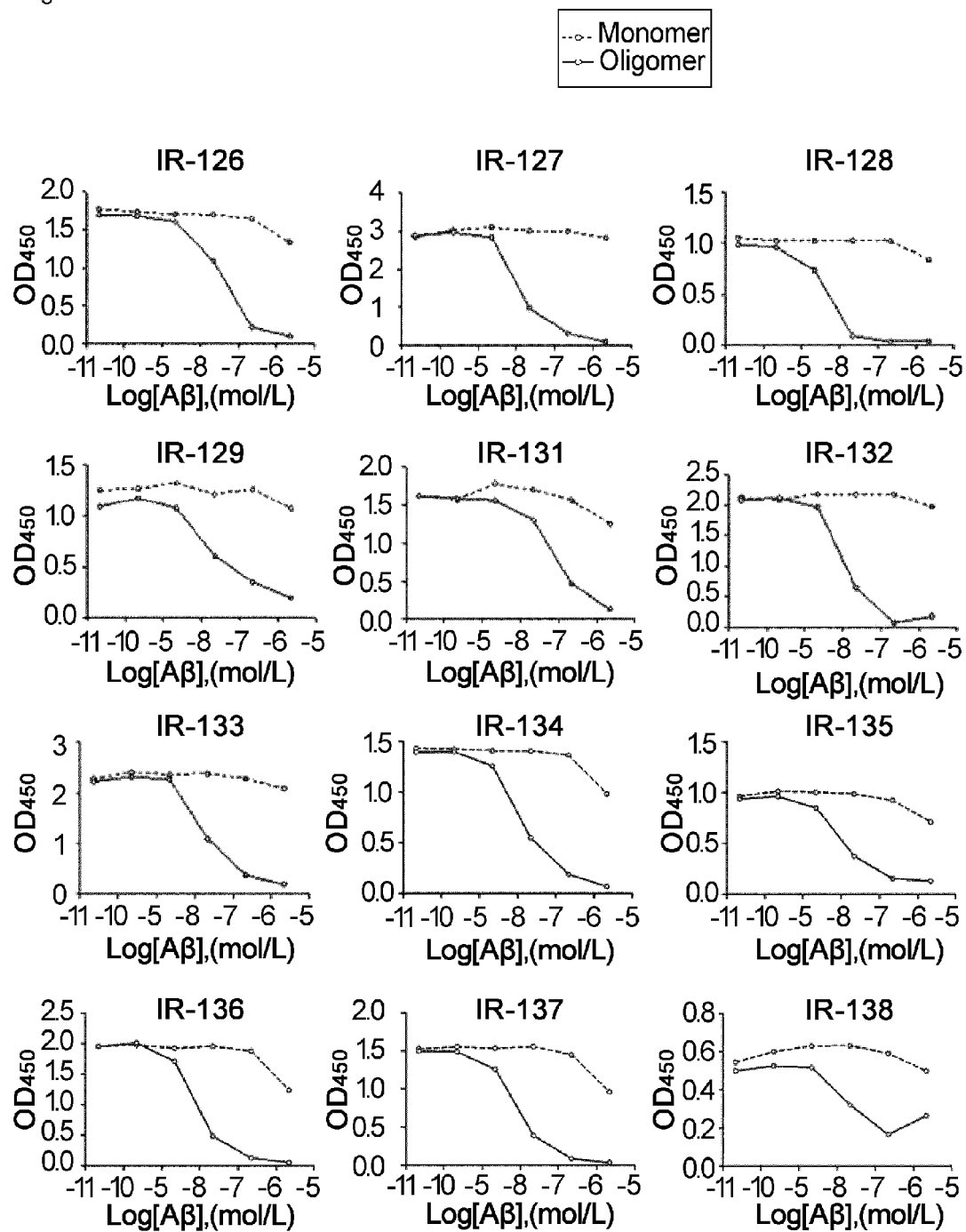
Figures 3, 4, 5, 6, 7, 8, 9, 10:
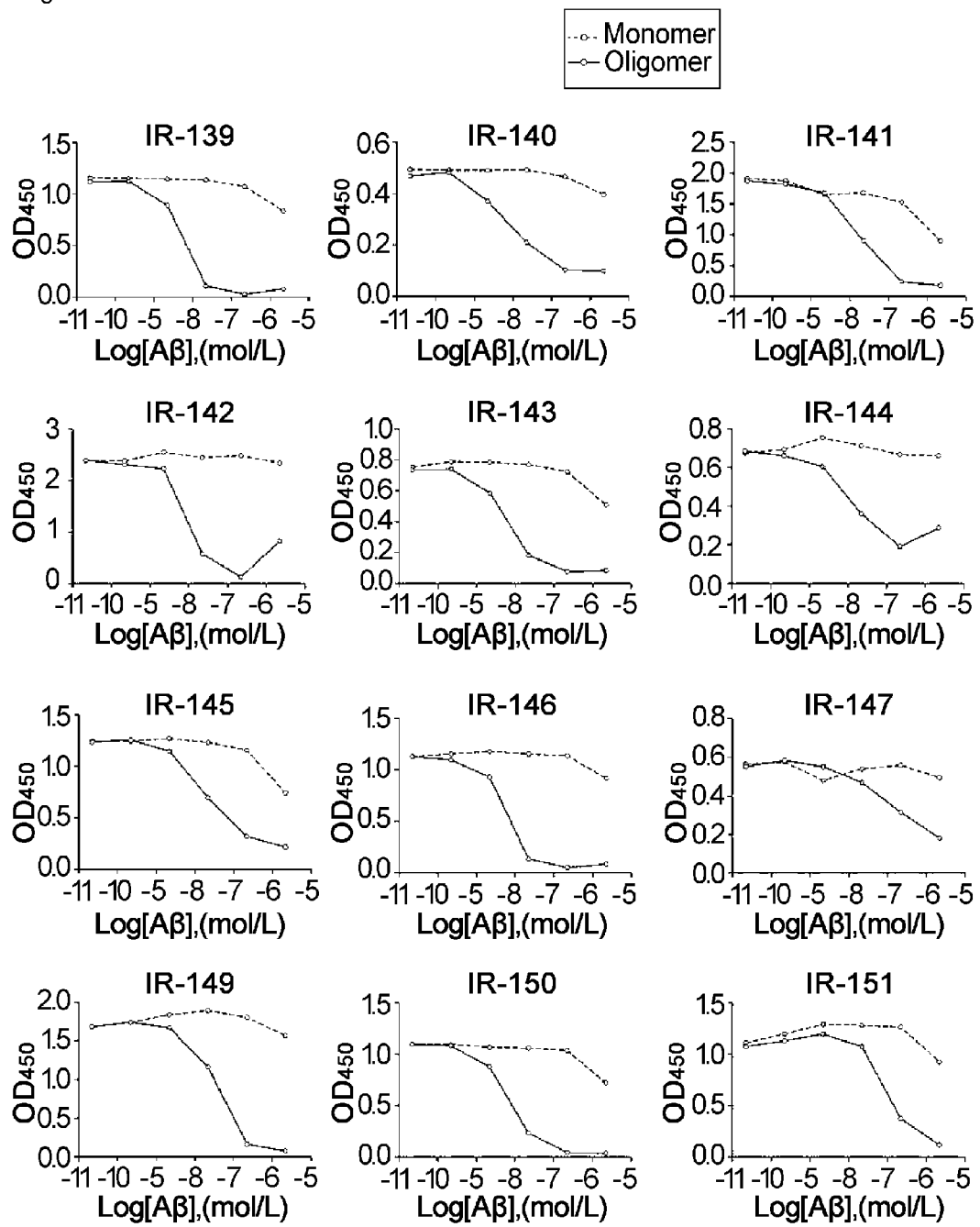
Figures 3, 4, 5, 6, 7, 8, 9, 10, 11:
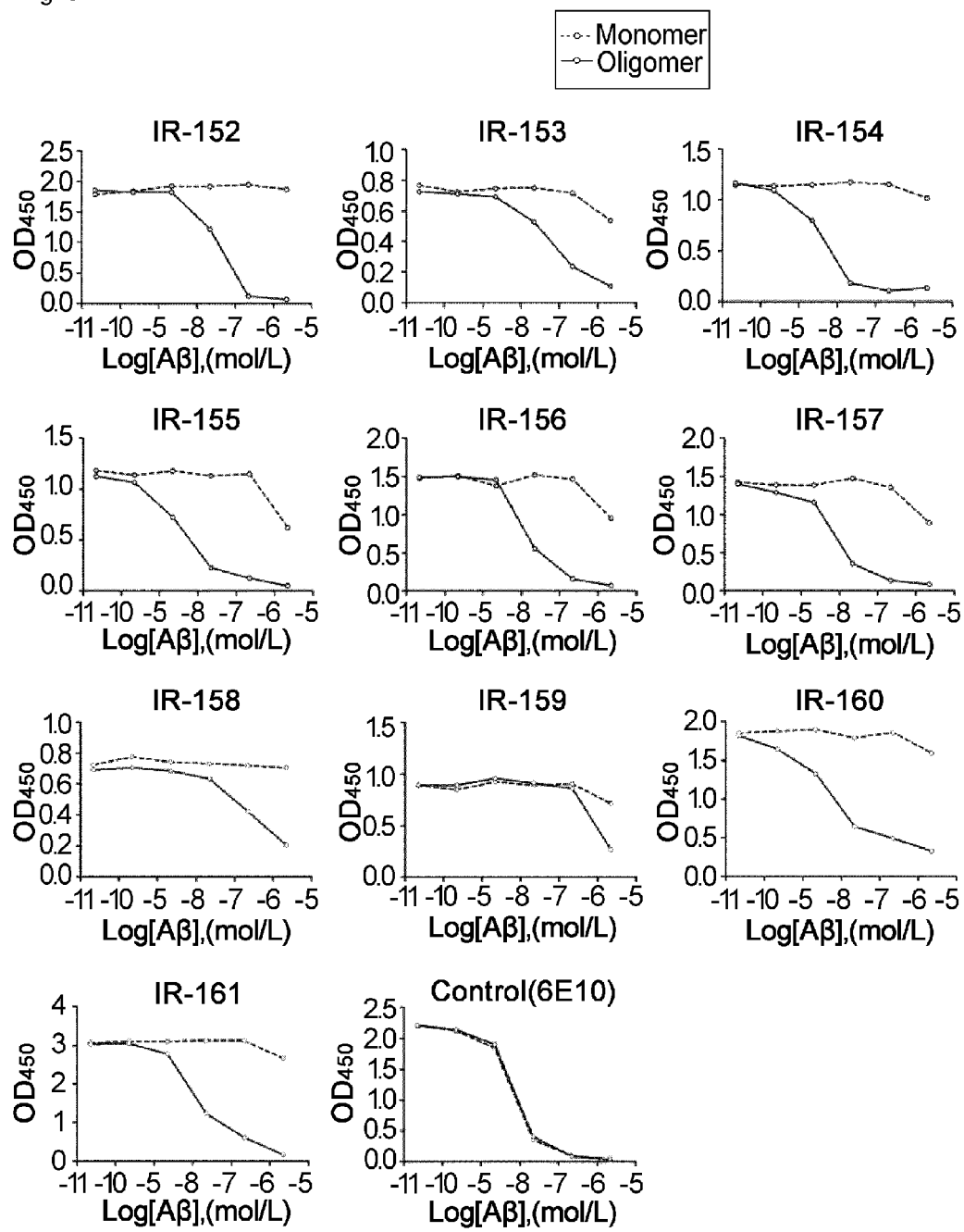
Figures 1, 4:
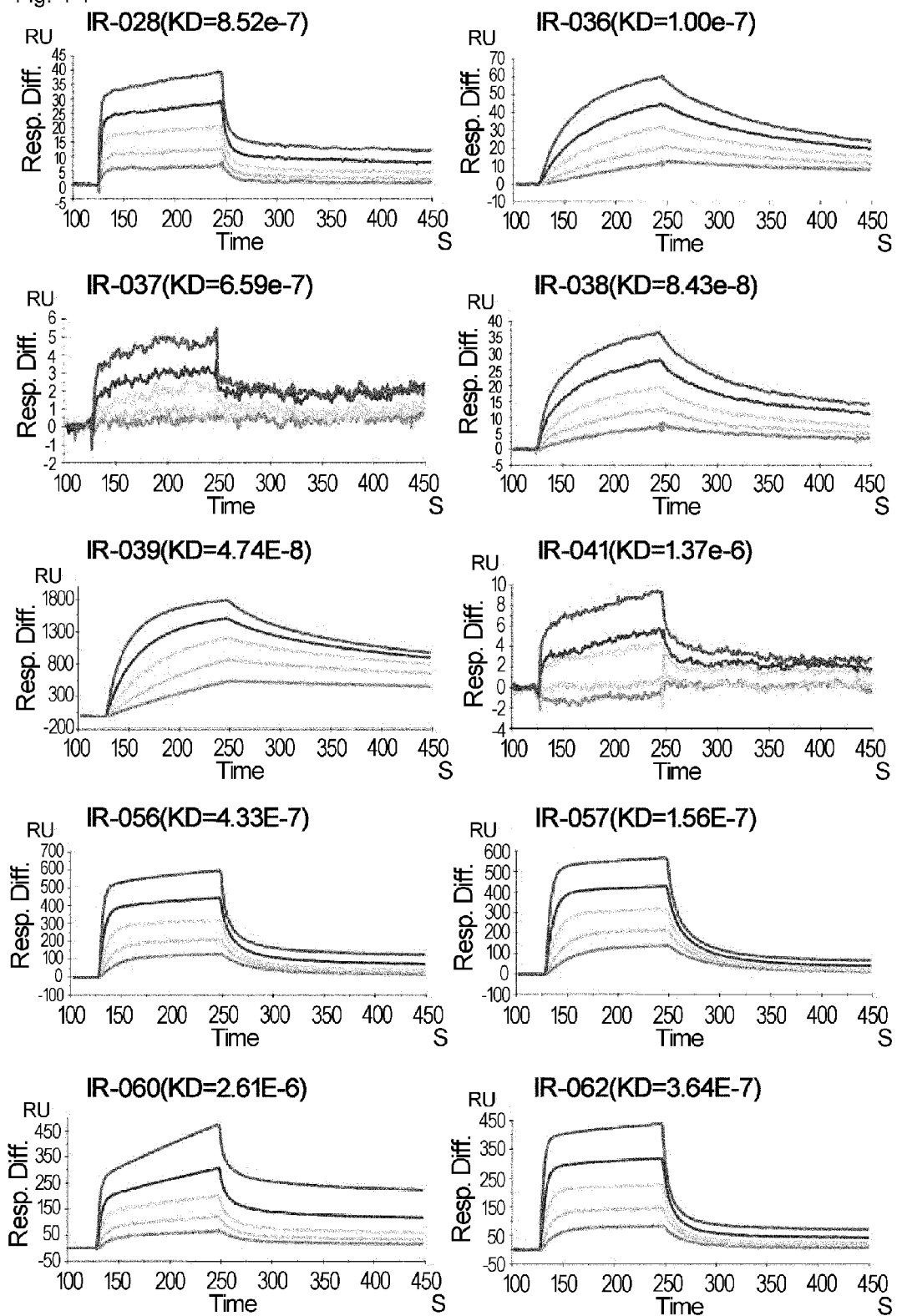
Figures 2, 4:
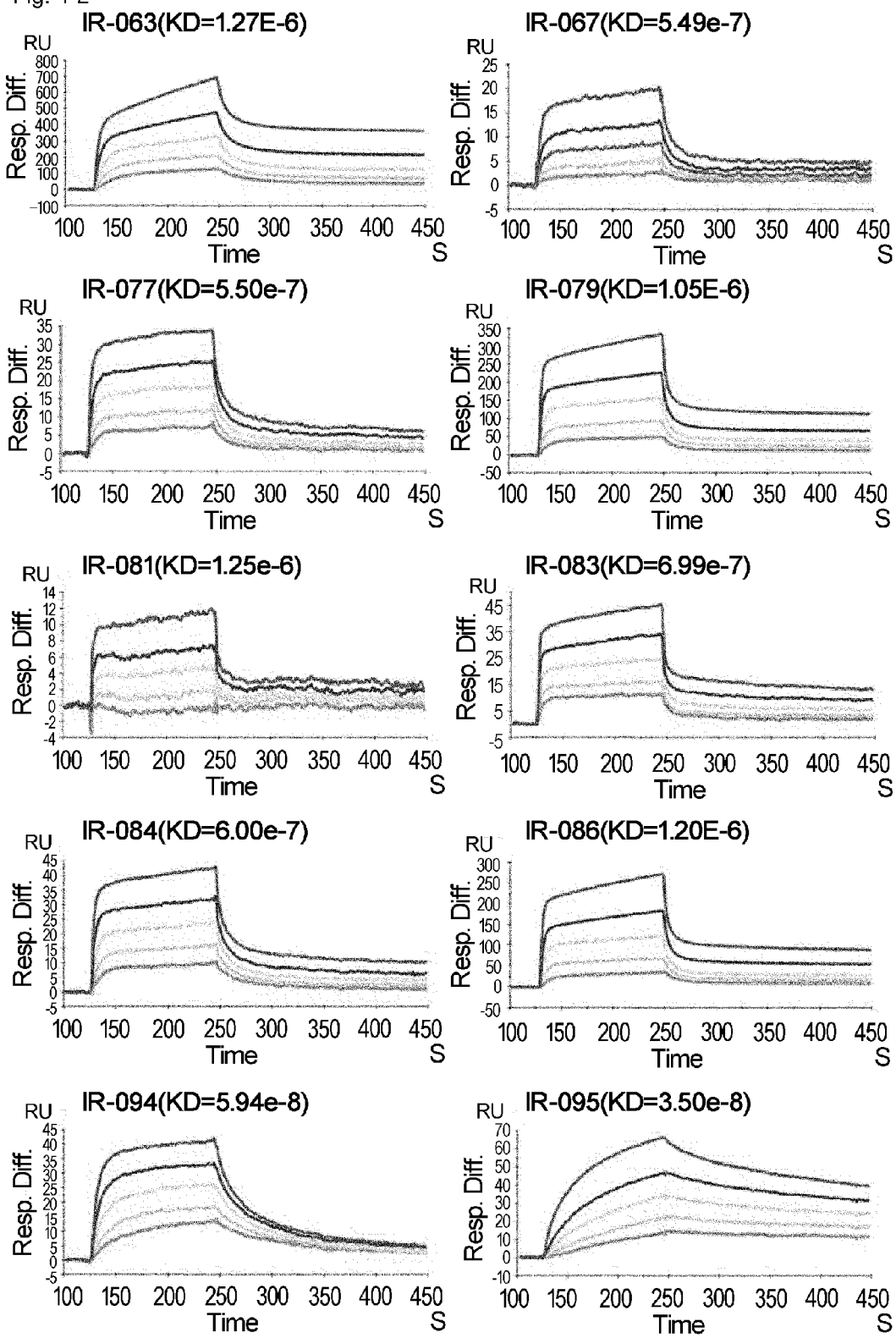
Figures 3, 4:
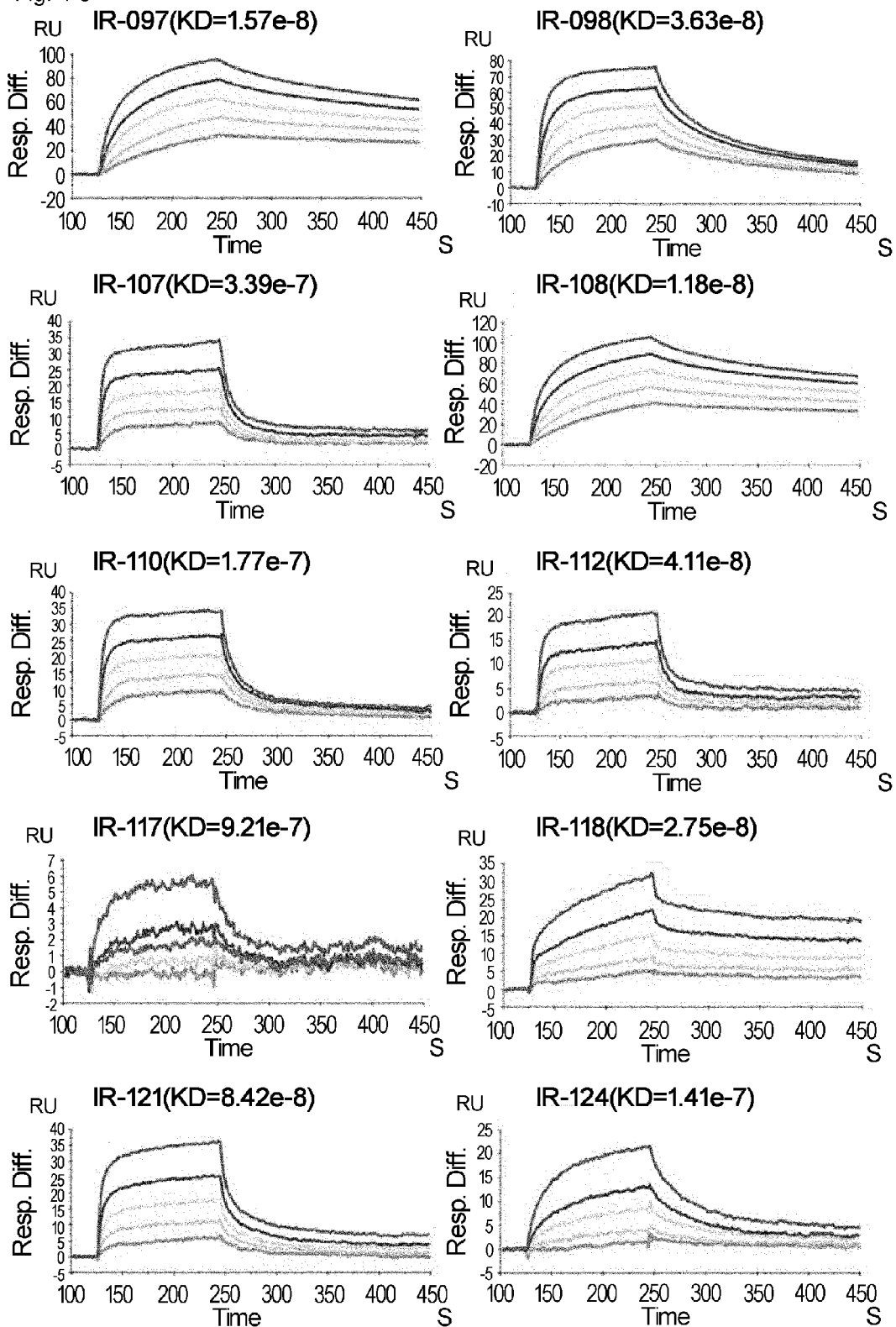
Figure 4:
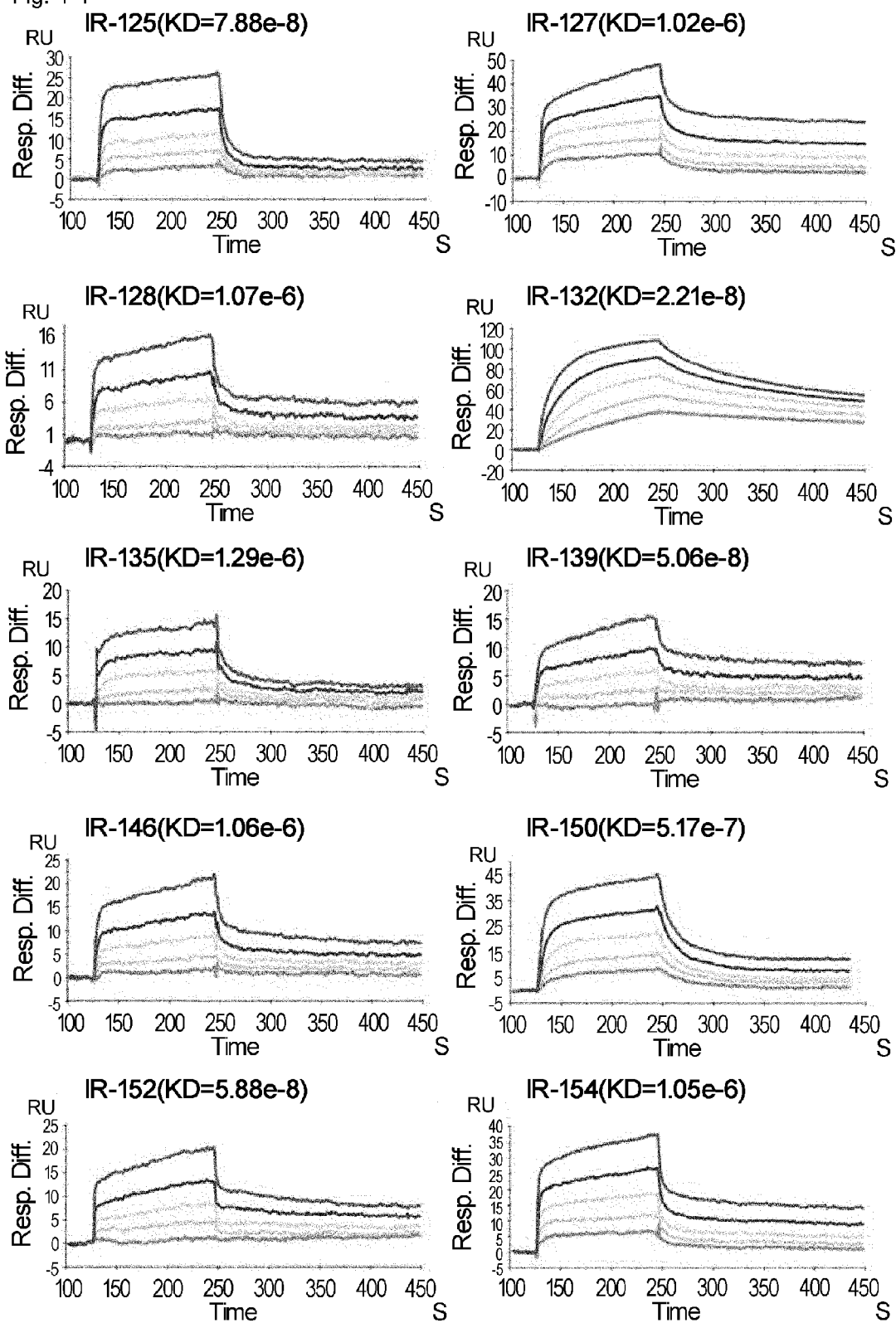
Figures 4, 5:
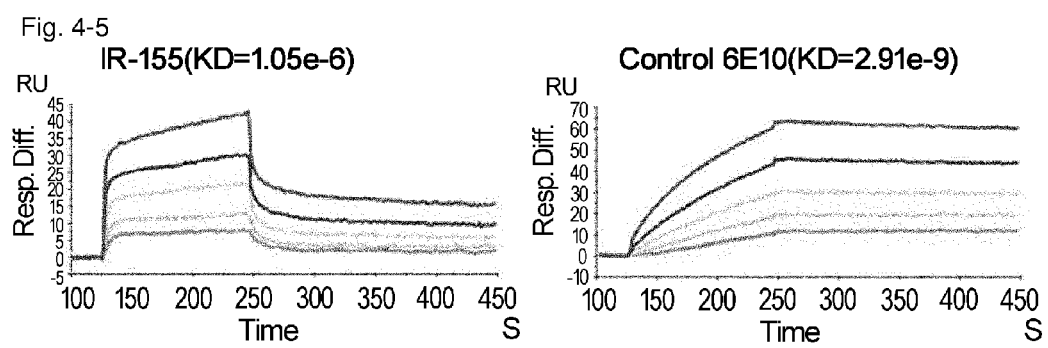
Figures 1, 5:
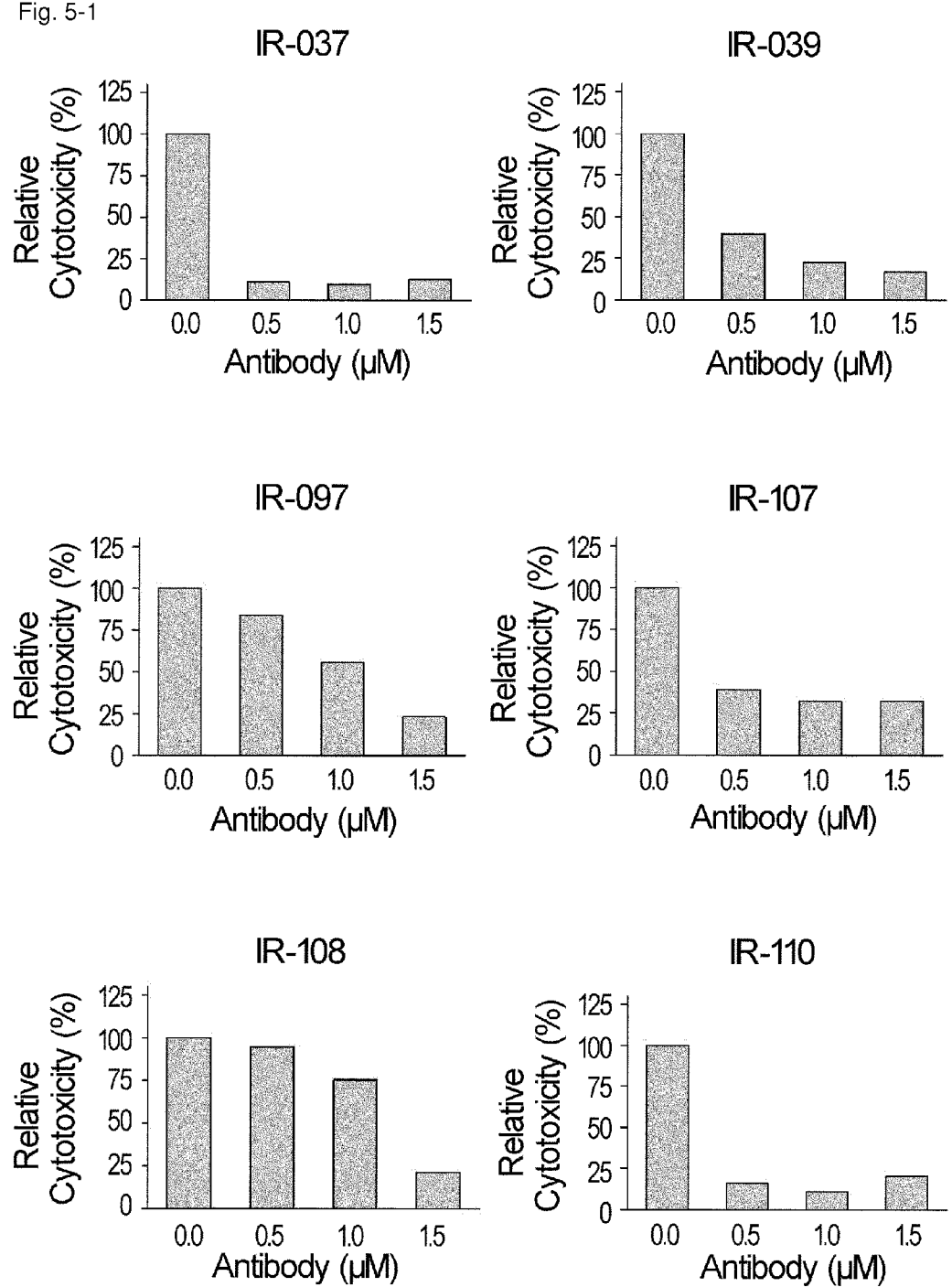
Figures 2, 5:
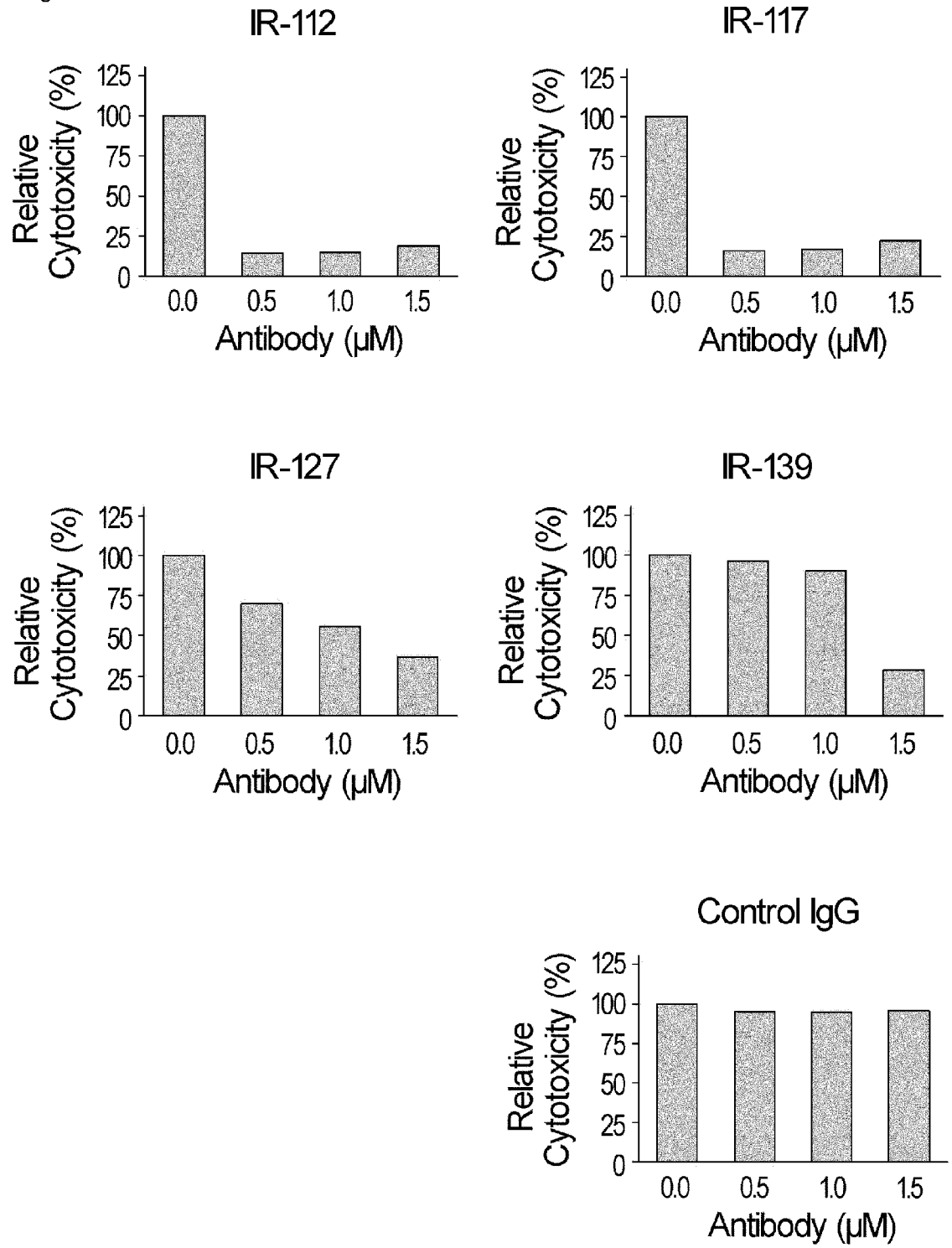
Figures 1, 6:
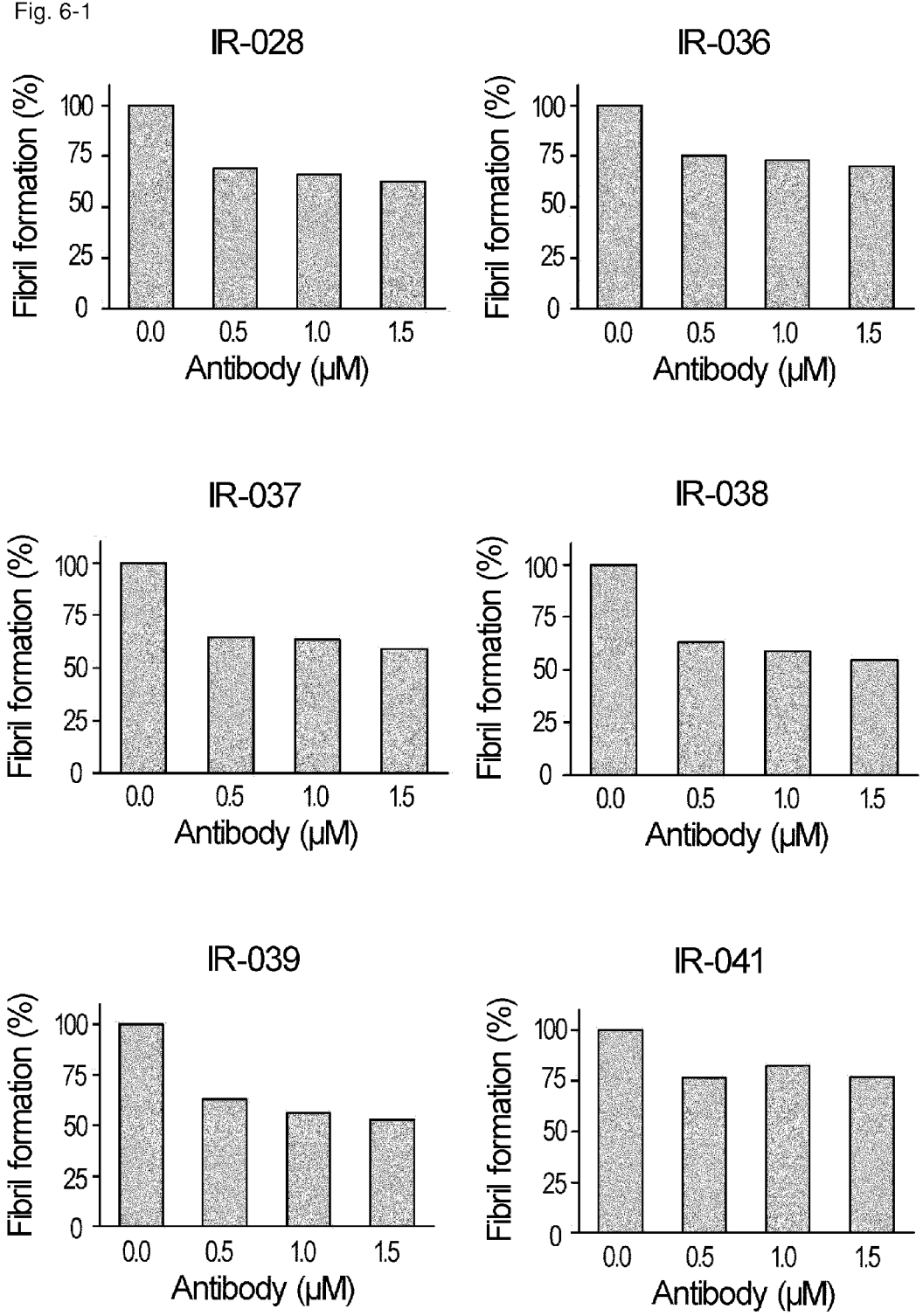
Figures 2, 6:
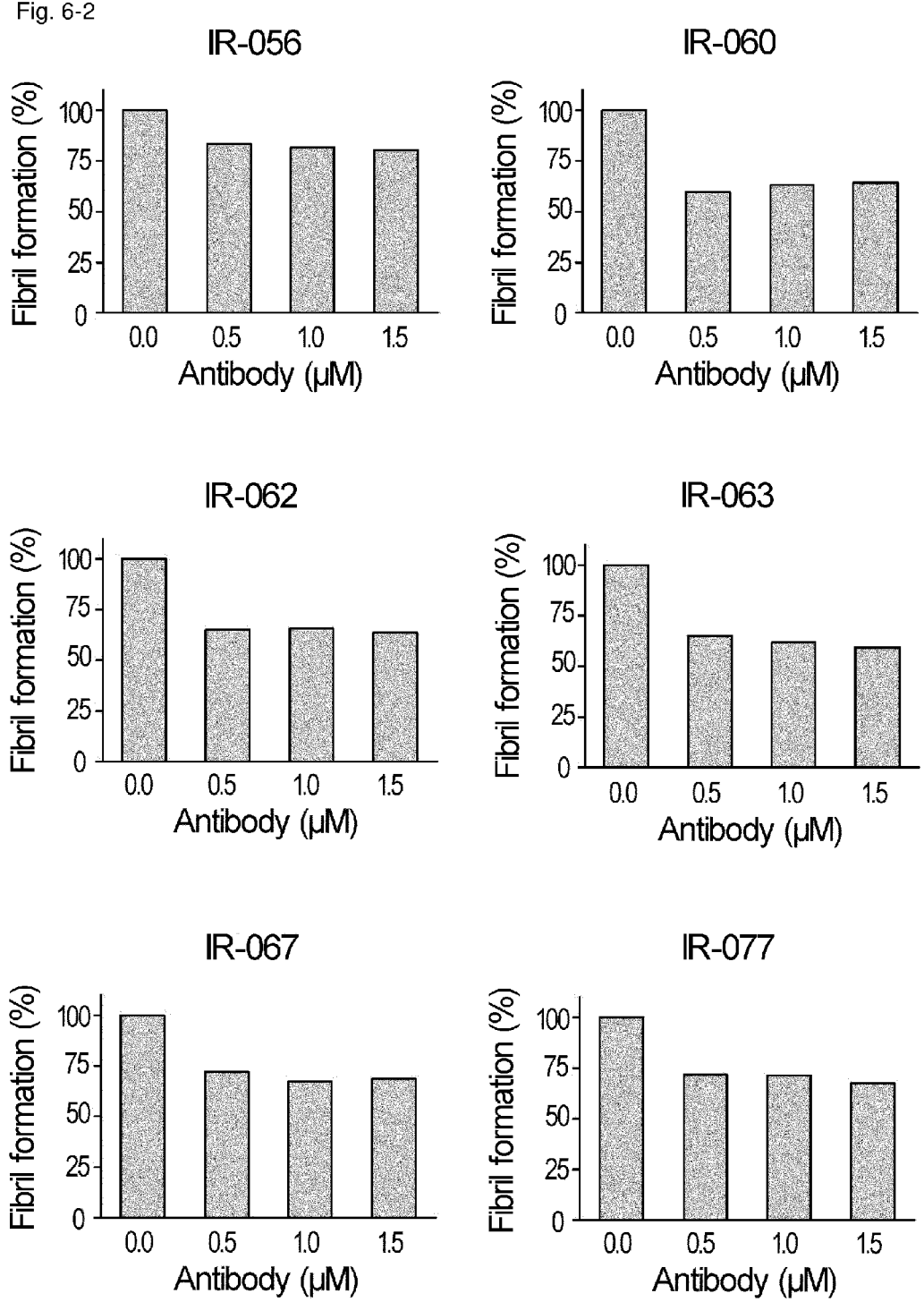
Figures 3, 6:
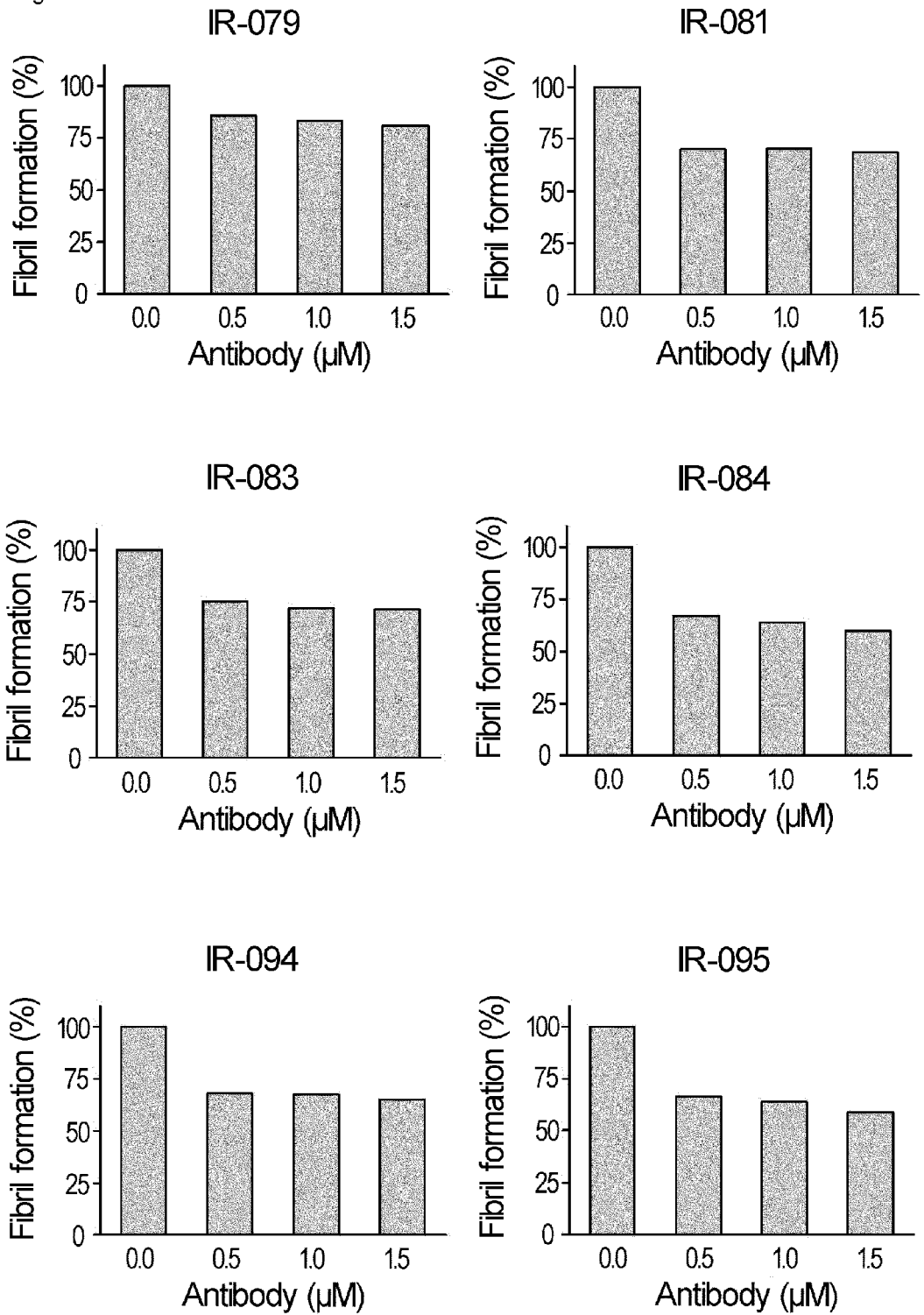
Figures 4, 6:
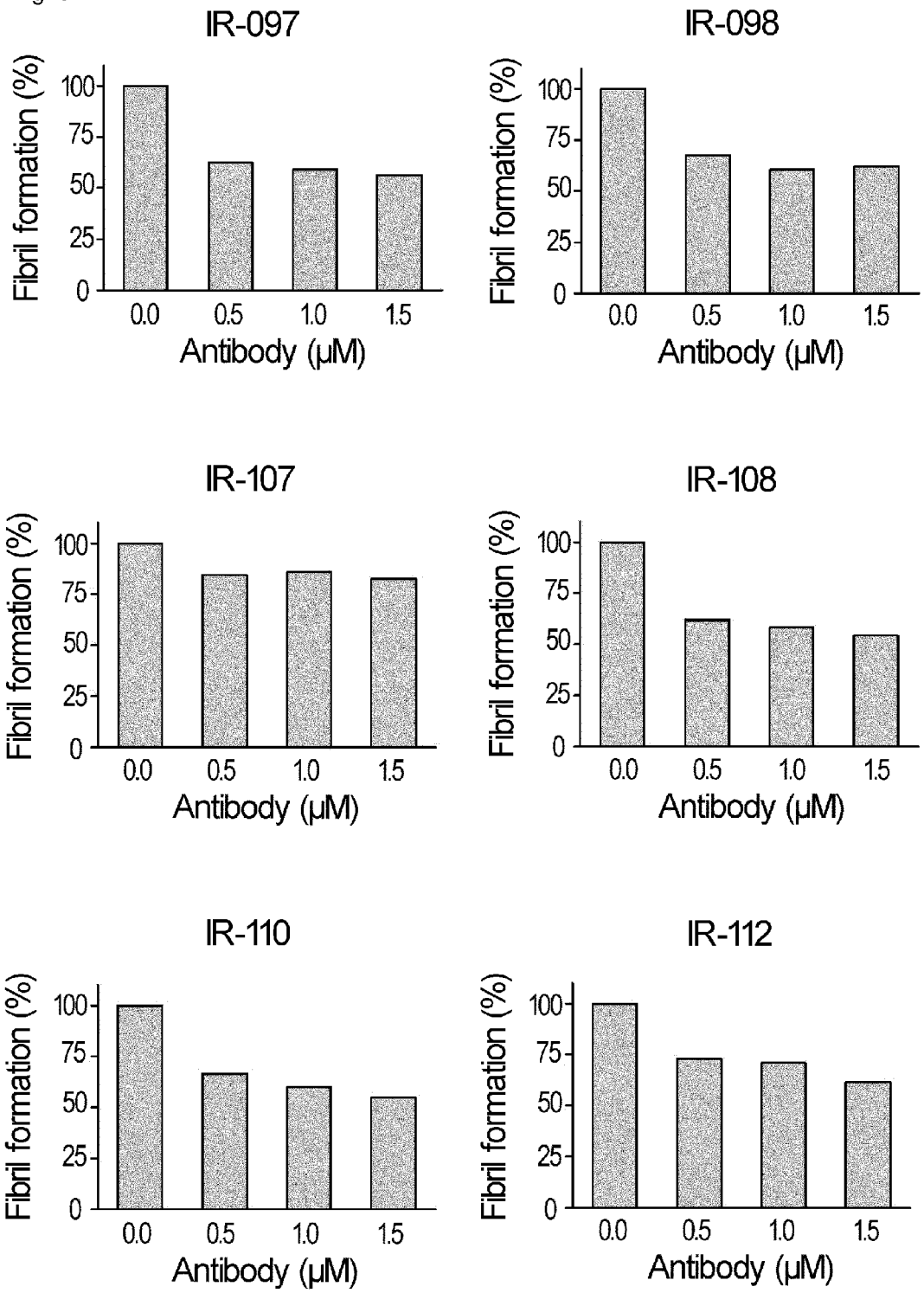
Figures 5, 6:
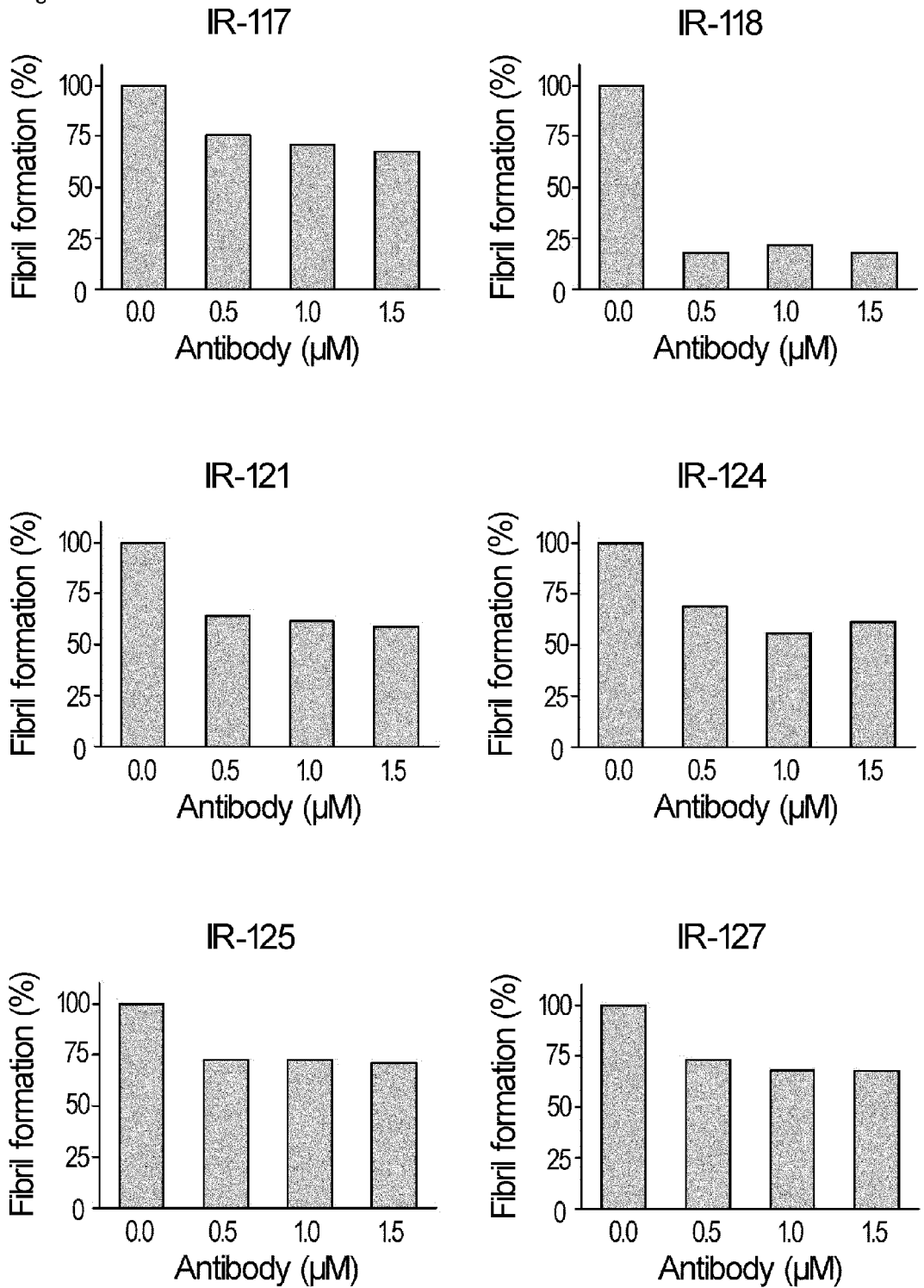
Figure 6:
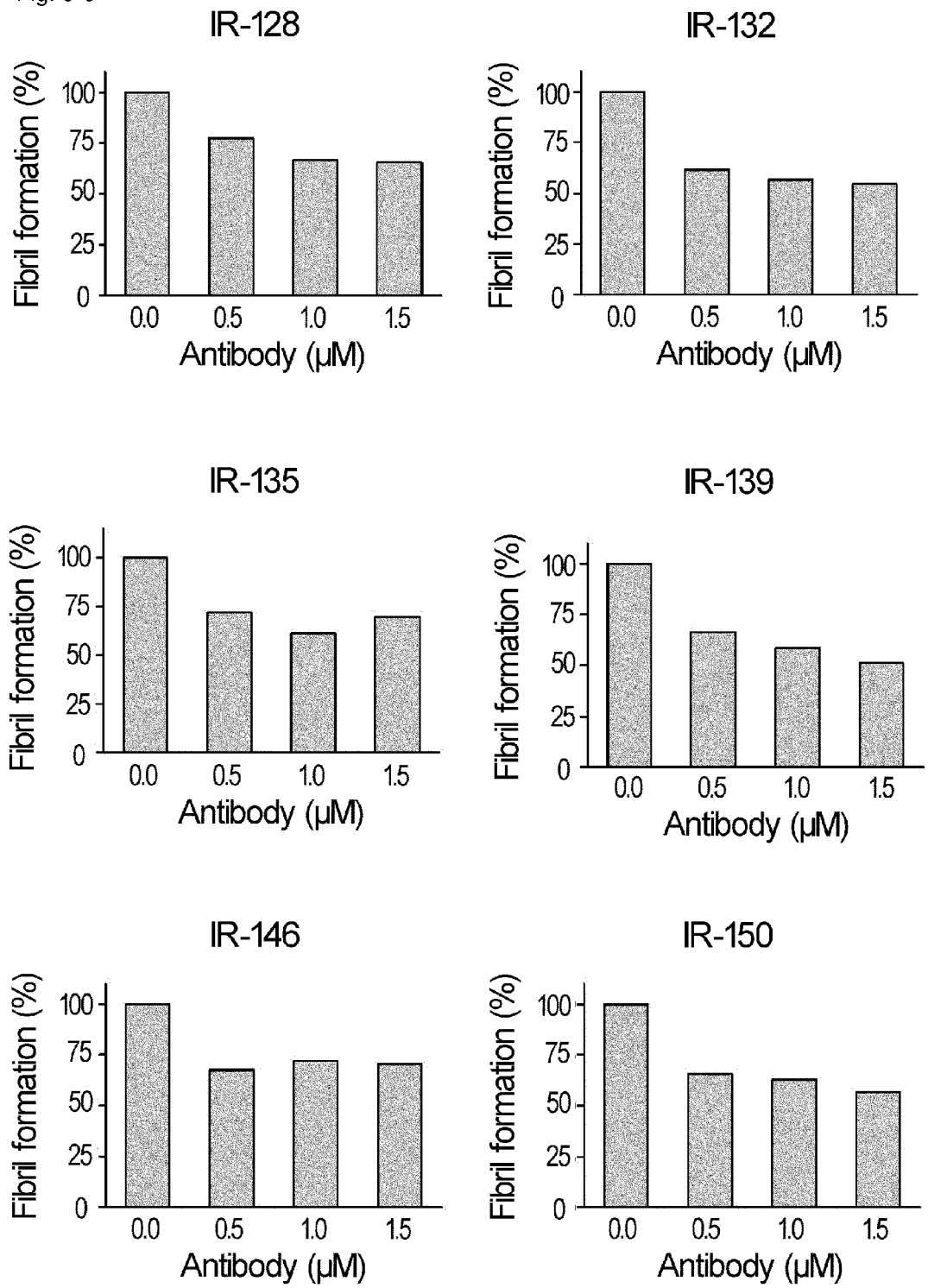
Figures 6, 7:
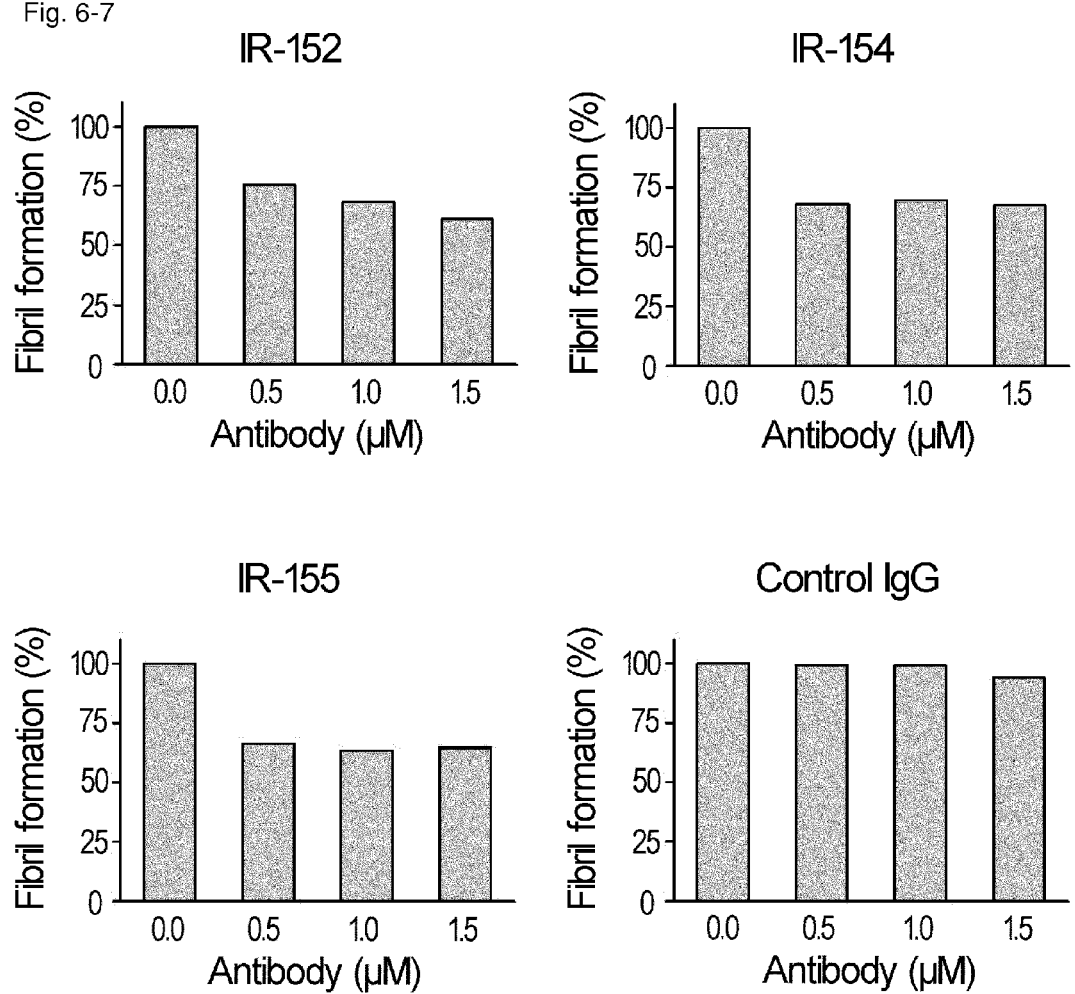
Figures 2, 7:
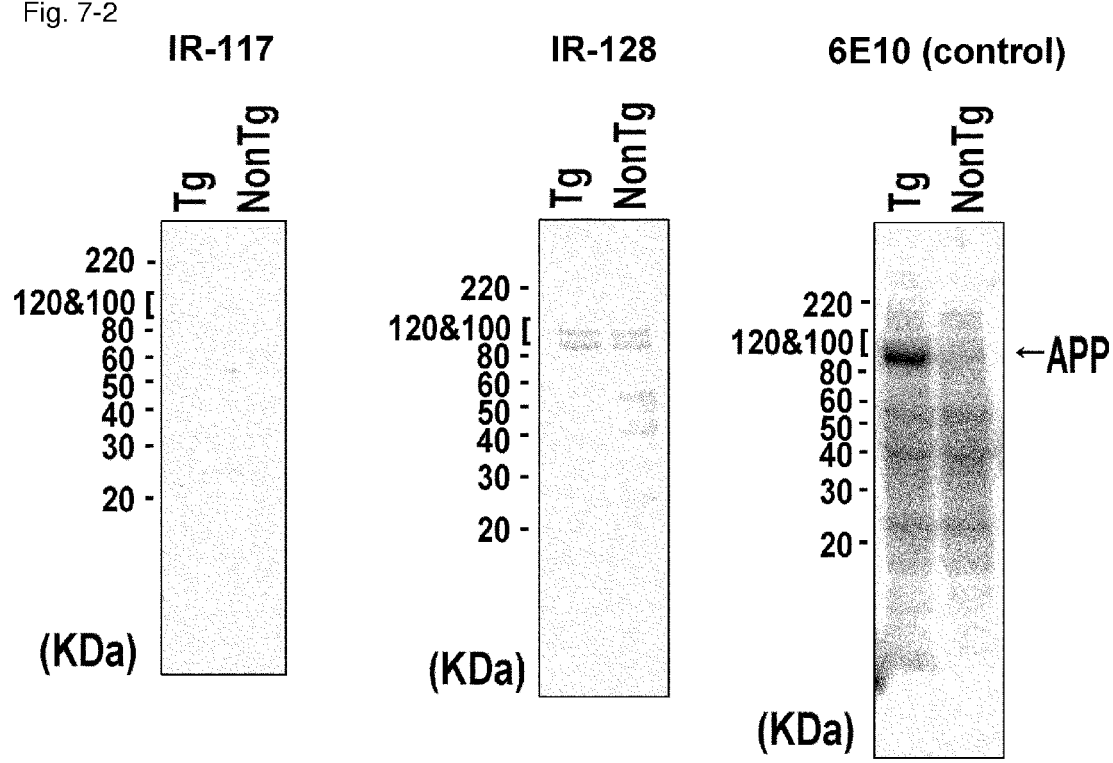

It is important for escape of side effect that anti-A beta antibodies do not bind to APP which is the physiological protein expressed in a healthy body. Anti-A beta oligomer antibodies are expected not to bind to APP because they recognize the conformational domain of A beta oligomer that is not present in APP. Therefore, immunoblotting was performed to assess whether the anti-A beta oligomer antibodies of the present invention do not bind to APP. It was confirmed that they do not bind to human APP (compared with the result of control 6E10 antibody). Examples of immunoblotting analysis are shown in FIG. 7. This data also shows that the antibodies of the present invention have low binding affinity to proteins other than A beta oligomer, and the specificity of the antibodies is high (compared with the result of control 6E10 antibody).

INDUSTRIAL APPLICABILITY

The antibodies provided by the present invention are expected to contribute to the establishment of preventive/therapeutic methods selective to molecules responsible for evoking pathological conditions of Alzheimer's disease, and the establishment of early diagnostic markers for Alzheimer's disease.

SEQUENCE LISTING (2976 sequences)

SEQ ID NO: 1 - DNA, 294 bp, Mus musculus
acctgcacggtctctggtttctcattaactagctatggtgtacactgggttcgccagtctccaggaaagggtctggagtggctgggagtgatatggagtggtggaagcacagactataatgcagctttcatatccagactgagcatcagcaaggacaattccaagagccaagttttctttaaaatgaacagtctgcaagctaatgacacagccatatattactgtgccagaaaaacgagcccggagggggggtttgcttactggggccaagggactctggtcactgtctctgca

SEQ ID NO: 2 - protein, 98 aa, Mus musculus
TCTVSGFSLTSYGVHWVRQSPGKGLEWLGVIWSGGSTDYNAAFISRLSISKDNSKSQVFFKMNSLQANDTAIYYCARKTSPEGGFAYWGQGTLVTVSA

SEQ ID NO: 3 - DNA, 276 bp, Mus musculus
atgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatctgtacacgttcggaggggggaccaagctggaaataaaa

SEQ ID NO: 4 - protein, 92 aa, Mus musculus
MSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 5 - DNA, 15 bp, Mus musculus
agctatggtgtacac

SEQ ID NO: 6 - protein, 5 aa, Mus musculus
SYGVH

SEQ ID NO: 7 - DNA, 48 bp, Mus musculus
gtgatatggagtggtggaagcacagactataatgcagctttcatatcc

SEQ ID NO: 8 - protein, 16 aa, Mus musculus
VIWSGGSTDYNAAFIS

SEQ ID NO: 9 - DNA, 30 bp, Mus musculus
aaaacgagcccggagggggggtttgcttac

SEQ ID NO: 10 - protein, 10 aa, Mus musculus
KTSPEGGFAY

SEQ ID NO: 11 - DNA, 51 bp, Mus musculus
aaatccagtcagagtctgctcaacagtagaacccgaaagaactacttggct

SEQ ID NO: 12 - protein, 17 aa, Mus musculus
KSSQSLLNSRTRKNYLA

SEQ ID NO: 13 - DNA, 21 bp, Mus musculus
tgggcatccactagggaatct

SEQ ID NO: 14 - protein, 7 aa, Mus musculus
WASTRES

SEQ ID NO: 15 - DNA, 24 bp, Mus musculus
aagcaatcttataatctgtacacg

SEQ ID NO: 16 - protein, 8 aa, Mus musculus
KQSYNLYT

SEQ ID NO: 17 - DNA, 417 bp, Mus musculus
atgaacttcgggctcagcttgattttccttgccctcattttaaaaggtgtccagtgtgaggtgcagctggtggagtctgggggagacttagtgaagcctggagggtccctgaaactctcctgtgcagcctctggattcactttcagtagctatggcatgtcttgggttcgccagactccagacaagaggctggactgggtcgcaaccattagtagtggtggtagttacacctactatccagacagtgtgaaggggcgattcaccatctccagagacaatgccaagaacaccctgtacctgcaaatgagcagtctgaagtctgaggacacagccatgtattactgtgcaagatctactatgattgcgacggggacttttgcttactggggccaagggactctggtcactgtctctgca

SEQ ID NO: 18 - protein, 139 aa, Mus musculus
MNFGLSLIFLALILKGVQCEVQLVESGGDLVKPGGSLKLSCAASGFTFSSYGMSWVRQTPDKRLDWVATISSGGSYTYYPDSVKGRFTISRDNAKNTLYLQMSSLKSEDTAMYYCARSTMIATGTFAYWGQGTLVTVSA

SEQ ID NO: 19 - DNA, 327 bp, Mus musculus
atgacccaaagtccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtggacgttcggtggaggcaccaagctggaaatcaaa

SEQ ID NO: 20 - protein, 109 aa, Mus musculus
MTQSPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 21 - DNA, 15 bp, Mus musculus
agctatggcatgtct

SEQ ID NO: 22 - protein, 5 aa, Mus musculus
SYGMS

SEQ ID NO: 23 - DNA, 51 bp, Mus musculus
accattagtagtggtggtagttacacctactatccagacagtgtgaagggg

SEQ ID NO: 24 - protein, 17 aa, Mus musculus
TISSGGSYTYYPDSVKG

SEQ ID NO: 25 - DNA, 33 bp, Mus musculus
tctactatgattgcgacggggacttttgcttac

SEQ ID NO: 26 - protein, 11 aa, Mus musculus
STMIATGTFAY

SEQ ID NO: 27 - DNA, 48 bp, Mus musculus
agatctagtcagagcattgtacatagtaatggaaacacctatttagaa

SEQ ID NO: 28 - protein, 16 aa, Mus musculus
RSSQSIVHSNGNTYLE

SEQ ID NO: 29 - DNA, 21 bp, Mus musculus
aaagtttccaaccgattttct

SEQ ID NO: 30 - protein, 7 aa, Mus musculus
KVSNRFS

SEQ ID NO: 31 - DNA, 27 bp, Mus musculus
tttcaaggttcacatgttccgtggacg

SEQ ID NO: 32 - protein, 9 aa, Mus musculus
FQGSHVPWT

SEQ ID NO: 33 - DNA, 414 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgatactacggtagtagcccctttgactactggggccaaggcaccactctcacagtctcctca

SEQ ID NO: 34 - protein, 138 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYYGSSPFDYWGQGTTLTVSS

SEQ ID NO: 35 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggggtttatttctgctctcaaagtacacatgttccgctcacgttcggtgctgggaccaagctggagctgaaa

SEQ ID NO: 36 - protein, 109 aa, Mus musculus
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 37 - DNA, 21 bp, Mus musculus
acttctggtatgggtgtgagc

SEQ ID NO: 38 - protein, 7 aa, Mus musculus
TSGMGVS

SEQ ID NO: 39 - DNA, 48 bp, Mus musculus
cacatttactgggatgatgacaagcgctataacccatccctgaagagc

SEQ ID NO: 40 - protein, 16 aa, Mus musculus
HIYWDDDKRYNPSLKS

SEQ ID NO: 41 - DNA, 27 bp, Mus musculus
tactacggtagtagcccctttgactac

SEQ ID NO: 42 - protein, 9 aa, Mus musculus
YYGSSPFDY

SEQ ID NO: 43 - DNA, 48 bp, Mus musculus
agatctagtcagagccttgtacacagtaatggaaacacctatttacat

SEQ ID NO: 44 - protein, 16 aa, Mus musculus
RSSQSLVHSNGNTYLH

SEQ ID NO: 45 - DNA, 21 bp, Mus musculus
aaagtttccaaccgattttct

SEQ ID NO: 46 - protein, 7 aa, Mus musculus
KVSNRFS

SEQ ID NO: 47 - DNA, 27 bp, Mus musculus
tctcaaagtacacatgttccgctcacg

SEQ ID NO: 48 - protein, 9 aa, Mus musculus
SQSTHVPLT

SEQ ID NO: 49 - DNA, 408 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagagtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgattacgacaggggtttgcttactggggccaagggactctggtcactgtctctgca

SEQ ID NO: 50 - protein, 136 aa, Mus musculus
MDRLTSSFLLLIVPAYVLSQVTLKESGPGILQPSQTLSLTCSFSGFSLSTSGMGVSWIRQPSGKSLEWLAHIYWDDDKRYNPSLKSRLTISKDTSRNQVFLKITSVDTADTATYYCARLRQGFAYWGQGTLVTVSA

SEQ ID NO: 51 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcaaaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 52 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 53 - DNA, 21 bp, Mus musculus
acttctggtatgggtgtgagc

SEQ ID NO: 54 - protein, 7 aa, Mus musculus
TSGMGVS

SEQ ID NO: 55 - DNA, 48 bp, Mus musculus; identical to SEQ ID NO: 39

SEQ ID NO: 56 - protein, 16 aa, Mus musculus
HIYWDDDKRYNPSLKS

SEQ ID NO: 57 - DNA, 21 bp, Mus musculus
ttacgacaggggtttgcttac

SEQ ID NO: 58 - protein, 7 aa, Mus musculus
LRQGFAY

SEQ ID NO: 59 - DNA, 48 bp, Mus musculus; identical to SEQ ID NO: 27

SEQ ID NO: 60 - protein, 16 aa, Mus musculus
RSSQSIVHSNGNTYLE

SEQ ID NO: 61 - DNA, 21 bp, Mus musculus
aaagtttccaaccgattttct

SEQ ID NO: 62 - protein, 7 aa, Mus musculus
KVSNRFS

SEQ ID NO: 63 - DNA, 27 bp, Mus musculus
tttcaaggttcacatgttccgctcacg

SEQ ID NO: 64 - protein, 9 aa, Mus musculus
FQGSHVPLT

SEQ ID NO: 65 - DNA, 408 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcggtacggtagtagctttgcttactggggccaagggactctggtcactgtctctgca

SEQ ID NO: 66 - protein, 136 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGSSFAYWGQGTLVTVSA

SEQ ID NO: 67 - DNA, 276 bp, Mus musculus; identical to SEQ ID NO: 3

SEQ ID NO: 68 - protein, 92 aa, Mus musculus; identical to SEQ ID NO: 4

SEQ ID NO: 69 - DNA, 21 bp, Mus musculus
acttctggtatgggtgtgagc

SEQ ID NO: 70 - protein, 7 aa, Mus musculus
TSGMGVS

SEQ ID NO: 71 - DNA, 48 bp, Mus musculus; identical to SEQ ID NO: 39

SEQ ID NO: 72 - protein, 16 aa, Mus musculus
HIYWDDDKRYNPSLKS

SEQ ID NO: 73 - DNA, 21 bp, Mus musculus
tacggtagtagctttgcttac

SEQ ID NO: 74 - protein, 7 aa, Mus musculus
YGSSFAY

SEQ ID NO: 75 - DNA, 51 bp, Mus musculus; identical to SEQ ID NO: 11

SEQ ID NO: 76 - protein, 17 aa, Mus musculus
KSSQSLLNSRTRKNYLA

SEQ ID NO: 77 - DNA, 21 bp, Mus musculus
tgggcatccactagggaatct

SEQ ID NO: 78 - protein, 7 aa, Mus musculus
WASTRES

SEQ ID NO: 79 - DNA, 24 bp, Mus musculus
aagcaatcttataatctgtacacg

SEQ ID NO: 80 - protein, 8 aa, Mus musculus
KQSYNLYT

SEQ ID NO: 81 - DNA, 420 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagggttactacgtcgggatgctatggactactggggtcaaggaacctcagtcaccgtctcctca

SEQ ID NO: 82 - protein, 140 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLLRRDAMDYWGQGTSVTVSS

SEQ ID NO: 83 - DNA, 327 bp, Mus musculus; identical to SEQ ID NO: 51

SEQ ID NO: 84 - protein, 109 aa, Mus musculus; identical to SEQ ID NO: 52

SEQ ID NO: 85 - DNA, 21 bp, Mus musculus
acttctggtatgggtgtgagc

SEQ ID NO: 86 - protein, 7 aa, Mus musculus
TSGMGVS

SEQ ID NO: 87 - DNA, 48 bp, Mus musculus; identical to SEQ ID NO: 39

SEQ ID NO: 88 - protein, 16 aa, Mus musculus
HIYWDDDKRYNPSLKS

SEQ ID NO: 89 - DNA, 33 bp, Mus musculus
agagggttactacgtcgggatgctatggactac

SEQ ID NO: 90 - protein, 11 aa, Mus musculus
RGLLRRDAMDY

SEQ ID NO: 91 - DNA, 48 bp, Mus musculus; identical to SEQ ID NO: 27

SEQ ID NO: 92 - protein, 16 aa, Mus musculus
RSSQSIVHSNGNTYLE

SEQ ID NO: 93 - DNA, 21 bp, Mus musculus
aaagtttccaaccgattttct

SEQ ID NO: 94 - protein, 7 aa, Mus musculus
KVSNRFS

SEQ ID NO: 95 - DNA, 27 bp, Mus musculus
tttcaaggttcacatgttccgctcacg

SEQ ID NO: 96 - protein, 9 aa, Mus musculus
FQGSHVPLT

SEQ ID NO: 97 - DNA, 423 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagctctctacggtaaccttgactactttgactactggggccaaggcaccactctcacagtctcctca

SEQ ID NO: 98 - protein, 141 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYGNLDYFDYWGQGTTLTVSS

SEQ ID NO: 99 - DNA, 276 bp, Mus musculus; identical to SEQ ID NO: 3

SEQ ID NO: 100 - protein, 92 aa, Mus musculus; identical to SEQ ID NO: 4

SEQ ID NO: 101 - DNA, 21 bp, Mus musculus
acttctggtatgggtgtaggc

SEQ ID NO: 102 - protein, 7 aa, Mus musculus
TSGMGVG

SEQ ID NO: 103 - DNA, 48 bp, Mus musculus
cacatttggtgggatgatgataagtactataacccatccctgaagagc

SEQ ID NO: 104 - protein, 16 aa, Mus musculus
HIWWDDDKYYNPSLKS

SEQ ID NO: 105 - DNA, 36 bp, Mus musculus
agagctctctacggtaaccttgactactttgactac

SEQ ID NO: 106 - protein, 12 aa, Mus musculus
RALYGNLDYFDY

SEQ ID NO: 107 - DNA, 51 bp, Mus musculus; identical to SEQ ID NO: 11

SEQ ID NO: 108 - protein, 17 aa, Mus musculus
KSSQSLLNSRTRKNYLA

SEQ ID NO: 109 - DNA, 21 bp, Mus musculus
tgggcatccactagggaatct

SEQ ID NO: 110 - protein, 7 aa, Mus musculus
WASTRES

SEQ ID NO: 111 - DNA, 24 bp, Mus musculus
aagcaatcttataatctgtacacg

SEQ ID NO: 112 - protein, 8 aa, Mus musculus
KQSYNLYT

SEQ ID NO: 113 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagcgaggtacgacgaggggctatggactactggggtcaaggaacctcagtcaccgtctcctca

SEQ ID NO: 114 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSEVRRGAMDYWGQGTSVTVSS

SEQ ID NO: 115 - DNA, 276 bp, Mus musculus; identical to SEQ ID NO: 3

SEQ ID NO: 116 - protein, 92 aa, Mus musculus; identical to SEQ ID NO: 4

SEQ ID NO: 117 - DNA, 15 bp, Mus musculus
agctttggaatgcac

SEQ ID NO: 118 - protein, 5 aa, Mus musculus
SFGMH

SEQ ID NO: 119 - DNA, 51 bp, Mus musculus
tacattagtagtggcagtagtaccatctactatgcagacacagtgaagggc

SEQ ID NO: 120 - protein, 17 aa, Mus musculus
YISSGSSTIYYADTVKG

SEQ ID NO: 121 - DNA, 30 bp, Mus musculus
agcgaggtacgacgaggggctatggactac

SEQ ID NO: 122 - protein, 10 aa, Mus musculus
SEVRRGAMDY

SEQ ID NO: 123 - DNA, 51 bp, Mus musculus; identical to SEQ ID NO: 11

SEQ ID NO: 124 - protein, 17 aa, Mus musculus
KSSQSLLNSRTRKNYLA

SEQ ID NO: 125 - DNA, 21 bp, Mus musculus
tgggcatccactagggaatct

SEQ ID NO: 126 - protein, 7 aa, Mus musculus
WASTRES

SEQ ID NO: 127 - DNA, 24 bp, Mus musculus
aagcaatcttataatctgtacacg

SEQ ID NO: 128 - protein, 8 aa, Mus musculus
KQSYNLYT

SEQ ID NO: 129 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagccctttatgattacgactactttgactactggggccaaggcaccactctcacagtctcctca

SEQ ID NO: 130 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYDYDYFDYWGQGTTLTVSS

SEQ ID NO: 131 - DNA, 276 bp, Mus musculus; identical to SEQ ID NO: 3

SEQ ID NO: 132 - protein, 92 aa, Mus musculus; identical to SEQ ID NO: 4

SEQ ID NO: 133 - DNA, 21 bp, Mus musculus
acttctggtatgggtgtaggc

SEQ ID NO: 134 - protein, 7 aa, Mus musculus
TSGMGVG

SEQ ID NO: 135 - DNA, 48 bp, Mus musculus; identical to SEQ ID NO: 103

SEQ ID NO: 136 - protein, 16 aa, Mus musculus
HIWWDDDKYYNPSLKS

SEQ ID NO: 137 - DNA, 33 bp, Mus musculus
agagccctttatgattacgactactttgactac

SEQ ID NO: 138 - protein, 11 aa, Mus musculus
RALYDYDYFDY

SEQ ID NO: 139 - DNA, 51 bp, Mus musculus; identical to SEQ ID NO: 11

SEQ ID NO: 140 - protein, 17 aa, Mus musculus
KSSQSLLNSRTRKNYLA

SEQ ID NO: 141 - DNA, 21 bp, Mus musculus
tgggcatccactagggaatct

SEQ ID NO: 142 - protein, 7 aa, Mus musculus
WASTRES

SEQ ID NO: 143 - DNA, 24 bp, Mus musculus
aagcaatcttataatctgtacacg

SEQ ID NO: 144 - protein, 8 aa, Mus musculus
KQSYNLYT

SEQ ID NO: 145 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgagggattacgacgcgttactatactatggactactggggtcaaggaacctcagtcaccgtctcctca

SEQ ID NO: 146 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARGITTRYYTMDYWGQGTSVTVSS

SEQ ID NO: 147 - DNA, 276 bp, Mus musculus; identical to SEQ ID NO: 3

SEQ ID NO: 148 - protein, 92 aa, Mus musculus; identical to SEQ ID NO: 4

SEQ ID NO: 149 - DNA, 21 bp, Mus musculus
acttctggtatgggtgtaggc

SEQ ID NO: 150 - protein, 7 aa, Mus musculus
TSGMGVG

SEQ ID NO: 151 - DNA, 48 bp, Mus musculus; identical to SEQ ID NO: 103

SEQ ID NO: 152 - protein, 16 aa, Mus musculus
HIWWDDDKYYNPSLKS

SEQ ID NO: 153 - DNA, 33 bp, Mus musculus
gggattacgacgcgttactatactatggactac

SEQ ID NO: 154 - protein, 11 aa, Mus musculus
GITTRYYTMDY

SEQ ID NO: 155 - DNA, 51 bp, Mus musculus; identical to SEQ ID NO: 11

SEQ ID NO: 156 - protein, 17 aa, Mus musculus
KSSQSLLNSRTRKNYLA

SEQ ID NO: 157 - DNA, 21 bp, Mus musculus
tgggcatccactagggaatct

SEQ ID NO: 158 - protein, 7 aa, Mus musculus
WASTRES

SEQ ID NO: 159 - DNA, 24 bp, Mus musculus
aagcaatcttataatctgtacacg

SEQ ID NO: 160 - protein, 8 aa, Mus musculus
KQSYNLYT

SEQ ID NO: 161 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgttcgaagaggactctatgattacgacaggtttgcttactggggccaagggactctggtcactgtctctgca

SEQ ID NO: 162 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCVRRGLYDYDRFAYWGQGTLVTVSA

SEQ ID NO: 163 - DNA, 327 bp, Mus musculus
atgacccaaactccactctccctgcctgtcagtcttggagatcaagcctccatctcttgcagatctagtcagggcattgtccatagtactggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 164 - protein, 109 aa, Mus musculus
MTQTPLSLPVSLGDQASISCRSSQGIVHSTGNTYLEWYLQKPGQSPKLLIYKVSNRFSGVPDRFSGSGSGTDFTLKISRVEAEDLGVYYCFQGSHVPLTFGAGTKLELK

SEQ ID NO: 165 - DNA, 21 bp, Mus musculus
acttctggtatgggtgtaggc

SEQ ID NO: 166 - protein, 7 aa, Mus musculus
TSGMGVG

SEQ ID NO: 167 - DNA, 48 bp, Mus musculus; identical to SEQ ID NO: 103

SEQ ID NO: 168 - protein, 16 aa, Mus musculus
HIWWDDDKYYNPSLKS

SEQ ID NO: 169 - DNA, 33 bp, Mus musculus
agaggactctatgattacgacaggtttgcttac

SEQ ID NO: 170 - protein, 11 aa, Mus musculus
RGLYDYDRFAY

SEQ ID NO: 171 - DNA, 48 bp, Mus musculus
agatctagtcagggcattgtccatagtactggaaacacctatttagaa

SEQ ID NO: 172 - protein, 16 aa, Mus musculus
RSSQGIVHSTGNTYLE

SEQ ID NO: 173 - DNA, 21 bp, Mus musculus
aaagtttccaaccgattttct

SEQ ID NO: 174 - protein, 7 aa, Mus musculus
KVSNRFS

SEQ ID NO: 175 - DNA, 27 bp, Mus musculus
tttcaaggttcacatgttccgctcacg

SEQ ID NO: 176 - protein, 9 aa, Mus musculus
FQGSHVPLT

SEQ ID NO: 177 - DNA, 420 bp, Mus musculus; identical to SEQ ID NO: 145

SEQ ID NO: 178 - protein, 140 aa, Mus musculus; identical to SEQ ID NO: 146

SEQ ID NO: 179 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttatcactgctttcaaggttcacatgttccgctcacgttcggtgctgggaccaagctggagctgaaa

SEQ ID NO: 180 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYHCFQGSHVPLTFGAGTKLELK

SEQ ID NO: 181 - DNA, 21 bp, Mus musculus
acttctggtatgggtgtaggc

SEQ ID NO: 182 - protein, 7 aa, Mus musculus
TSGMGVG

SEQ ID NO: 183 - DNA, 48 bp, Mus musculus; identical to SEQ ID NO: 103

SEQ ID NO: 184 - protein, 16 aa, Mus musculus
HIWWDDDKYYNPSLKS

SEQ ID NO: 185 - DNA, 33 bp, Mus musculus; identical to SEQ ID NO: 153

SEQ ID NO: 186 - protein, 11 aa, Mus musculus
GITTRYYTMDY

SEQ ID NO: 187 - DNA, 48 bp, Mus musculus; identical to SEQ ID NO: 27

SEQ ID NO: 188 - protein, 16 aa, Mus musculus
RSSQSIVHSNGNTYLE

SEQ ID NO: 189 - DNA, 21 bp, Mus musculus
aaagtttccaaccgattttct

SEQ ID NO: 190 - protein, 7 aa, Mus musculus
KVSNRFS

SEQ ID NO: 191 - DNA, 27 bp, Mus musculus
tttcaaggttcacatgttccgctcacg

SEQ ID NO: 192 - protein, 9 aa, Mus musculus
FQGSHVPLT

SEQ ID NO: 193 - DNA, 408 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgctacggtagtagctttgcttactggggccaagggactctggtcactgtctctgca

SEQ ID NO: 194 - protein, 136 aa, Mus musculus; identical to SEQ ID NO: 66

SEQ ID NO: 195 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 196 - protein, 109 aa, Mus musculus; identical to SEQ ID NO: 52

SEQ ID NO: 197 - DNA, 21 bp, Mus musculus
acttctggtatgggtgtgagc

SEQ ID NO: 198 - protein, 7 aa, Mus musculus
TSGMGVS

SEQ ID NO: 199 - DNA, 48 bp, Mus musculus; identical to SEQ ID NO: 39

SEQ ID NO: 200 - protein, 16 aa, Mus musculus
HIYWDDDKRYNPSLKS

SEQ ID NO: 201 - DNA, 21 bp, Mus musculus
tacggtagtagctttgcttac

SEQ ID NO: 202 - protein, 7 aa, Mus musculus
YGSSFAY

SEQ ID NO: 203 - DNA, 48 bp, Mus musculus; identical to SEQ ID NO: 27

SEQ ID NO: 204 - protein, 16 aa, Mus musculus
RSSQSIVHSNGNTYLE

SEQ ID NO: 205 - DNA, 21 bp, Mus musculus
aaagtttccaaccgattttct

SEQ ID NO: 206 - protein, 7 aa, Mus musculus
KVSNRFS

SEQ ID NO: 207 - DNA, 27 bp, Mus musculus
tttcaaggttcacatgttccgctcacg

SEQ ID NO: 208 - protein, 9 aa, Mus musculus
FQGSHVPLT

SEQ ID NO: 209 - DNA, 426 bp, Mus musculus
atggacaggcttacttcctcattcctgctgctgattgtccctgcatatgtcctttcccaggttactctgaaagagtctggccctgggatattgcagccctcccagacccacagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaaaaggggtctactatgattacgacgtcgggtttgcttactggggccaagggactctggtcactgtctctgca

SEQ ID NO: 210 - protein, 142 aa, Mus musculus
MDRLTSSFLLLIVPAYVLSQVTLKESGPGILQPSQTHSLTCSFSGFSLSTSGMGVSWIRQPSGKGLEWLAHIYWDDDKRYNPSLKSRLTISKDTSRNQVFLKITSVDTADTATYYCARKGVYYDYDVGFAYWGQGTLVTVSA

SEQ ID NO: 211 - DNA, 327 bp, Mus musculus; identical to SEQ ID NO: 195

SEQ ID NO: 212 - protein, 109 aa, Mus musculus; identical to SEQ ID NO: 52

SEQ ID NO: 213 - DNA, 21 bp, Mus musculus
acttctggtatgggtgtgagc

SEQ ID NO: 214 - protein, 7 aa, Mus musculus
TSGMGVS

SEQ ID NO: 215 - DNA, 48 bp, Mus musculus; identical to SEQ ID NO: 39

SEQ ID NO: 216 - protein, 16 aa, Mus musculus
HIYWDDDKRYNPSLKS

SEQ ID NO: 217 - DNA, 39 bp, Mus musculus
aaaggggtctactatgattacgacgtcgggtttgcttac

SEQ ID NO: 218 - protein, 13 aa, Mus musculus
KGVYYDYDVGFAY

SEQ ID NO: 219 - DNA, 48 bp, Mus musculus; identical to SEQ ID NO: 27

SEQ ID NO: 220 - protein, 16 aa, Mus musculus
RSSQSIVHSNGNTYLE

SEQ ID NO: 221 - DNA, 21 bp, Mus musculus
aaagtttccaaccgattttct

SEQ ID NO: 222 - protein, 7 aa, Mus musculus
KVSNRFS

SEQ ID NO: 223 - DNA, 27 bp, Mus musculus
tttcaaggttcacatgttccgctcacg

SEQ ID NO: 224 - protein, 9 aa, Mus musculus
FQGSHVPLT

SEQ ID NO: 225 - DNA, 423 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagccctttattactacggggattactttgactactggggccaaggcaccactctcacagtctcctca

SEQ ID NO: 226 - protein, 141 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYYYGDYFDYWGQGTTLTVSS

SEQ ID NO: 227 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggtgctgggaccaagctggagctgaaa

SEQ ID NO: 228 - protein, 109 aa, Mus musculus; identical to SEQ ID NO: 52

SEQ ID NO: 229 - DNA, 21 bp, Mus musculus
acttctggtatgggtgtaggc

SEQ ID NO: 230 - protein, 7 aa, Mus musculus
TSGMGVG

SEQ ID NO: 231 - DNA, 48 bp, Mus musculus; identical to SEQ ID NO: 103

SEQ ID NO: 232 - protein, 16 aa, Mus musculus
HIWWDDDKYYNPSLKS

SEQ ID NO: 233 - DNA, 36 bp, Mus musculus
agagccctttattactacggggattactttgactac

SEQ ID NO: 234 - protein, 12 aa, Mus musculus
RALYYYGDYFDY

SEQ ID NO: 235 - DNA, 48 bp, Mus musculus; identical to SEQ ID NO: 27

SEQ ID NO: 236 - protein, 16 aa, Mus musculus
RSSQSIVHSNGNTYLE

SEQ ID NO: 237 - DNA, 21 bp, Mus musculus
aaagtttccaaccgattttct

SEQ ID NO: 238 - protein, 7 aa, Mus musculus
KVSNRFS

SEQ ID NO: 239 - DNA, 27 bp, Mus musculus
tttcaaggttcacatgttcctctcacg

SEQ ID NO: 240 - protein, 9 aa, Mus musculus
FQGSHVPLT

SEQ ID NO: 241 - DNA, 420 bp, Mus musculus
atggacaggcttacttcttcattcctgctgctgattgtccctgcatatatcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagggatgattacgacggatgctatggactactggggtcaaggaacctcagtcaccgtctcctca

SEQ ID NO: 242 - protein, 140 aa, Mus musculus
MDRLTSSFLLLIVPAYILSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGMITTDAMDYWGQGTSVTVSS

SEQ ID NO: 243 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctccgacgttcggtggaggcaccaagctggaaatcaaa

SEQ ID NO: 244 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIK

SEQ ID NO: 245 - DNA, 21 bp, Mus musculus
acttctggtatgggtgtaggc

SEQ ID NO: 246 - protein, 7 aa, Mus musculus
TSGMGVG

SEQ ID NO: 247 - DNA, 48 bp, Mus musculus; identical to SEQ ID NO: 103

SEQ ID NO: 248 - protein, 16 aa, Mus musculus
HIWWDDDKYYNPSLKS

SEQ ID NO: 249 - DNA, 33 bp, Mus musculus
agagggatgattacgacggatgctatggactac

SEQ ID NO: 250 - protein, 11 aa, Mus musculus
RGMITTDAMDY

SEQ ID NO: 251 - DNA, 48 bp, Mus musculus; identical to SEQ ID NO: 27

SEQ ID NO: 252 - protein, 16 aa, Mus musculus
RSSQSIVHSNGNTYLE

SEQ ID NO: 253 - DNA, 21 bp, Mus musculus
aaagtttccaaccgattttct

SEQ ID NO: 254 - protein, 7 aa, Mus musculus
KVSNRFS

SEQ ID NO: 255 - DNA, 27 bp, Mus musculus
tttcaaggttcacatgttcctccgacg

SEQ ID NO: 256 - protein, 9 aa, Mus musculus
FQGSHVPPT

SEQ ID NO: 257 - DNA, 408 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcggtacggtagagggtttgcttactggggccaagggactctggtcactgtctctgca

SEQ ID NO: 258 - protein, 136 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGRGFAYWGQGTLVTVSA

SEQ ID NO: 259 - DNA, 327 bp, Mus musculus; identical to SEQ ID NO: 195

SEQ ID NO: 260 - protein, 109 aa, Mus musculus; identical to SEQ ID NO: 52

SEQ ID NO: 261 - DNA, 21 bp, Mus musculus
acttctggtatgggtgtgagc

SEQ ID NO: 262 - protein, 7 aa, Mus musculus
TSGMGVS

SEQ ID NO: 263 - DNA, 48 bp, Mus musculus; identical to SEQ ID NO: 39

SEQ ID NO: 264 - protein, 16 aa, Mus musculus
HIYWDDDKRYNPSLKS

SEQ ID NO: 265 - DNA, 21 bp, Mus musculus
tacggtagagggtttgcttac

SEQ ID NO: 266 - protein, 7 aa, Mus musculus
YGRGFAY

SEQ ID NO: 267 - DNA, 48 bp, Mus musculus; identical to SEQ ID NO: 27

SEQ ID NO: 268 - protein, 16 aa, Mus musculus
RSSQSIVHSNGNTYLE

SEQ ID NO: 269 - DNA, 21 bp, Mus musculus
aaagtttccaaccgattttct

SEQ ID NO: 270 - protein, 7 aa, Mus musculus
KVSNRFS

SEQ ID NO: 271 - DNA, 27 bp, Mus musculus
tttcaaggttcacatgttccgctcacg

SEQ ID NO: 272 - protein, 9 aa, Mus musculus
FQGSHVPLT

SEQ ID NO: 273 - DNA, 408 bp, Mus musculus
atgaactttgtgctcagcttgattttccttgccctcattttaaaaggtgtccagtgtgaagtgcagctggtggagtctgggggaggcttagtgaagcctggagggtccctgaaactctcctgtgcagcctctggattcactttcagtagctatgccatgtcttgggttcgccagactccggagaagaggctggagtgggtcgcaaccattagtagtggtggtagttacacctactatccagacagtgtgaagggtcgattcaccatctccagagacaatgccaagaacaccctgtacctgcaaatgagcagtctgaggtctgaggacacggccatgtattactgtgcaagacaaaactgggatgggtttgcttactggggccaagggactctggtcactgtctctgca

SEQ ID NO: 274 - protein, 136 aa, Mus musculus
MNFVLSLIFLALILKGVQCEVQLVESGGGLVKPGGSLKLSCAASGFTFSSYAMSWVRQTPEKRLEWVATISSGGSYTYYPDSVKGRFTISRDNAKNTLYLQMSSLRSEDTAMYYCARQNWDGFAYWGQGTLVTVSA

SEQ ID NO: 275 - DNA, 276 bp, Mus musculus
atgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttccgacgttcggtggaggcaccaagctggaaatcaaa

SEQ ID NO: 276 - protein, 92 aa, Mus musculus
MSCKSSQSLLNSRTRKNYLAWYQQKPGQSPKLLIYWASTRESGVPDRFTGSGSGTDFTLTISSVQAEDLAVYYCKQSYNLPTFGGGTKLEIK

SEQ ID NO: 277 - DNA, 15 bp, Mus musculus
agctatgccatgtct

SEQ ID NO: 278 - protein, 5 aa, Mus musculus
SYAMS

SEQ ID NO: 279 - DNA, 51 bp, Mus musculus
accattagtagtggtggtagttacacctactatccagacagtgtgaagggt

SEQ ID NO: 280 - protein, 17 aa, Mus musculus
TISSGGSYTYYPDSVKG

SEQ ID NO: 281 - DNA, 24 bp, Mus musculus
caaaactgggatgggtttgcttac

SEQ ID NO: 282 - protein, 8 aa, Mus musculus
QNWDGFAY

SEQ ID NO: 283 - DNA, 51 bp, Mus musculus; identical to SEQ ID NO: 11

SEQ ID NO: 284 - protein, 17 aa, Mus musculus
KSSQSLLNSRTRKNYLA

SEQ ID NO: 285 - DNA, 21 bp, Mus musculus
tgggcatccactagggaatct

SEQ ID NO: 286 - protein, 7 aa, Mus musculus
WASTRES

SEQ ID NO: 287 - DNA, 24 bp, Mus musculus
aagcaatcttataatcttccgacg

SEQ ID NO: 288 - protein, 8 aa, Mus musculus
KQSYNLPT

SEQ ID NO: 289 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtactcgaagagccctctatgattacgacgctatggactactggggtcaaggaacctcagtcaccgtctcctca

SEQ ID NO: 290 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCTRRALYDYDAMDYWGQGTSVTVSS

SEQ ID NO: 291 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggtgctgggaccaagctggagctgaaa

SEQ ID NO: 292 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGAGTKLELK

SEQ ID NO: 293 - DNA, 21 bp, Mus musculus
acttctggtatgggtgtaggc

SEQ ID NO: 294 - protein, 7 aa, Mus musculus
TSGMGVG

SEQ ID NO: 295 - DNA, 48 bp, Mus musculus; identical to SEQ ID NO: 103

SEQ ID NO: 296 - protein, 16 aa, Mus musculus
HIWWDDDKYYNPSLKS

SEQ ID NO: 297 - DNA, 33 bp, Mus musculus
agagccctctatgattacgacgctatggactac

SEQ ID NO: 298 - protein, 11 aa, Mus musculus
RALYDYDAMDY

SEQ ID NO: 299 - DNA, 48 bp, Mus musculus; identical to SEQ ID NO: 27

SEQ ID NO: 300 - protein, 16 aa, Mus musculus
RSSQSIVHSNGNTYLE

SEQ ID NO: 301 - DNA, 21 bp, Mus musculus
aaagtttccaaccgattttct

SEQ ID NO: 302 - protein, 7 aa, Mus musculus
KVSNRFS

SEQ ID NO: 303 - DNA, 27 bp, Mus musculus
tttcaaggttcacatgttcctcccacg

SEQ ID NO: 304 - protein, 9 aa, Mus musculus
FQGSHVPPT

SEQ ID NO: 305 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagcctactatggtaaccactttgactactggggccaaggcaccactctcacagtctcctca

SEQ ID NO: 306 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSAYYGNHFDYWGQGTTLTVSS

SEQ ID NO: 307 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcggacgttcggtggaggcaccaagctggaaatcaaa

SEQ ID NO: 308 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 309 - DNA, 15 bp, Mus musculus
agctttggaatgcac

SEQ ID NO: 310 - protein, 5 aa, Mus musculus
SFGMH

SEQ ID NO: 311 - DNA, 51 bp, Mus musculus; identical to SEQ ID NO: 119

SEQ ID NO: 312 - protein, 17 aa, Mus musculus
YISSGSSTIYYADTVKG

SEQ ID NO: 313 - DNA, 30 bp, Mus musculus
tcagcctactatggtaaccactttgactac

SEQ ID NO: 314 - protein, 10 aa, Mus musculus
SAYYGNHFDY

SEQ ID NO: 315 - DNA, 48 bp, Mus musculus; identical to SEQ ID NO: 27

SEQ ID NO: 316 - protein, 16 aa, Mus musculus
RSSQSIVHSNGNTYLE

SEQ ID NO: 317 - DNA, 21 bp, Mus musculus
aaagtttccaaccgattttct

SEQ ID NO: 318 - protein, 7 aa, Mus musculus
KVSNRFS

SEQ ID NO: 319 - DNA, 27 bp, Mus musculus
tttcaaggttcacatgttcctcggacg

SEQ ID NO: 320 - protein, 9 aa, Mus musculus
FQGSHVPRT

SEQ ID NO: 321 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaaggggttataggtacgacgagggatttgcttactggggccaagggactctggtcactgtctctgca

SEQ ID NO: 322 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGYRYDEGFAYWGQGTLVTVSA

SEQ ID NO: 323 - DNA, 327 bp, Mus musculus; identical to SEQ ID NO: 243

SEQ ID NO: 324 - protein, 109 aa, Mus musculus; identical to SEQ ID NO: 244

SEQ ID NO: 325 - DNA, 15 bp, Mus musculus
agctttggaatgcac

SEQ ID NO: 326 - protein, 5 aa, Mus musculus
SFGMH

SEQ ID NO: 327 - DNA, 51 bp, Mus musculus; identical to SEQ ID NO: 119

SEQ ID NO: 328 - protein, 17 aa, Mus musculus
YISSGSSTIYYADTVKG

SEQ ID NO: 329 - DNA, 30 bp, Mus musculus
ggttataggtacgacgagggatttgcttac

SEQ ID NO: 330 - protein, 10 aa, Mus musculus
GYRYDEGFAY

SEQ ID NO: 331 - DNA, 48 bp, Mus musculus; identical to SEQ ID NO: 27

SEQ ID NO: 332 - protein, 16 aa, Mus musculus
RSSQSIVHSNGNTYLE

SEQ ID NO: 333 - DNA, 21 bp, Mus musculus
aaagtttccaaccgattttct

SEQ ID NO: 334 - protein, 7 aa, Mus musculus
KVSNRFS

SEQ ID NO: 335 - DNA, 27 bp, Mus musculus
tttcaaggttcacatgttcctccgacg

SEQ ID NO: 336 - protein, 9 aa, Mus musculus
FQGSHVPPT

SEQ ID NO: 337 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaactgggacgggggctatggactactggggtcaaggaacctcagtcaccgtctcctca

SEQ ID NO: 338 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARTGTGAMDYWGQGTSVTVSS

SEQ ID NO: 339 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaa

SEQ ID NO: 340 - protein, 109 aa, Mus musculus
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIK

SEQ ID NO: 341 - DNA, 15 bp, Mus musculus
agctttggaatgcac

SEQ ID NO: 342 - protein, 5 aa, Mus musculus
SFGMH

SEQ ID NO: 343 - DNA, 51 bp, Mus musculus; identical to SEQ ID NO: 119

SEQ ID NO: 344 - protein, 17 aa, Mus musculus
YISSGSSTIYYADTVKG

SEQ ID NO: 345 - DNA, 24 bp, Mus musculus
actgggacgggggctatggactac

SEQ ID NO: 346 - protein, 8 aa, Mus musculus
TGTGAMDY

SEQ ID NO: 347 - DNA, 48 bp, Mus musculus; identical to SEQ ID NO: 43

SEQ ID NO: 348 - protein, 16 aa, Mus musculus
RSSQSLVHSNGNTYLH

SEQ ID NO: 349 - DNA, 21 bp, Mus musculus
aaagtttccaaccgattttct

SEQ ID NO: 350 - protein, 7 aa, Mus musculus
KVSNRFS

SEQ ID NO: 351 - DNA, 27 bp, Mus musculus
tctcaaagtacacatgttcctccgacg

SEQ ID NO: 352 - protein, 9 aa, Mus musculus
SQSTHVPPT

SEQ ID NO: 353 - DNA, 417 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagggttaaagaaggactactttgactactggggccaaggcaccactctcacagtctcctca

SEQ ID NO: 354 - protein, 139 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLKKDYFDYWGQGTTLTVSS

SEQ ID NO: 355 - DNA, 327 bp, Mus musculus; identical to SEQ ID NO: 51

SEQ ID NO: 356 - protein, 109 aa, Mus musculus; identical to SEQ ID NO: 52

SEQ ID NO: 357 - DNA, 21 bp, Mus musculus
acttctggtatgggtgtgagc

SEQ ID NO: 358 - protein, 7 aa, Mus musculus
TSGMGVS

SEQ ID NO: 359 - DNA, 48 bp, Mus musculus; identical to SEQ ID NO: 39

SEQ ID NO: 360 - protein, 16 aa, Mus musculus
HIYWDDDKRYNPSLKS

SEQ ID NO: 361 - DNA, 30 bp, Mus musculus
agagggttaaagaaggactactttgactac

SEQ ID NO: 362 - protein, 10 aa, Mus musculus
RGLKKDYFDY

SEQ ID NO: 363 - DNA, 48 bp, Mus musculus; identical to SEQ ID NO: 27

SEQ ID NO: 364 - protein, 16 aa, Mus musculus
RSSQSIVHSNGNTYLE

SEQ ID NO: 365 - DNA, 21 bp, Mus musculus
aaagtttccaaccgattttct

SEQ ID NO: 366 - protein, 7 aa, Mus musculus
KVSNRFS

SEQ ID NO: 367 - DNA, 27 bp, Mus musculus
tttcaaggttcacatgttccgctcacg

SEQ ID NO: 368 - protein, 9 aa, Mus musculus
FQGSHVPLT

SEQ ID NO: 369 - DNA, 414 bp, Mus musculus; identical to SEQ ID NO: 305

SEQ ID NO: 370 - protein, 138 aa, Mus musculus; identical to SEQ ID NO: 306

SEQ ID NO: 371 - DNA, 327 bp, Mus musculus; identical to SEQ ID NO: 307

SEQ ID NO: 372 - protein, 109 aa, Mus musculus; identical to SEQ ID NO: 308

SEQ ID NO: 373 - DNA, 15 bp, Mus musculus
agctttggaatgcac

SEQ ID NO: 374 - protein, 5 aa, Mus musculus
SFGMH

SEQ ID NO: 375 - DNA, 51 bp, Mus musculus; identical to SEQ ID NO: 119

SEQ ID NO: 376 - protein, 17 aa, Mus musculus
YISSGSSTIYYADTVKG

SEQ ID NO: 377 - DNA, 30 bp, Mus musculus; identical to SEQ ID NO: 313

SEQ ID NO: 378 - protein, 10 aa, Mus musculus
SAYYGNHFDY

SEQ ID NO: 379 - DNA, 48 bp, Mus musculus; identical to SEQ ID NO: 27

SEQ ID NO: 380 - protein, 16 aa, Mus musculus
RSSQSIVHSNGNTYLE

SEQ ID NO: 381 - DNA, 21 bp, Mus musculus
aaagtttccaaccgattttct

SEQ ID NO: 382 - protein, 7 aa, Mus musculus
KVSNRFS

SEQ ID NO: 383 - DNA, 27 bp, Mus musculus
tttcaaggttcacatgttcctcggacg

SEQ ID NO: 384 - protein, 9 aa, Mus musculus
FQGSHVPRT

SEQ ID NO: 385 - DNA, 408 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgtctgtatggtaacattgcttactggggccaagggactctggtcactgtctctgca

SEQ ID NO: 386 - protein, 136 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGNIAYWGQGTLVTVSA

SEQ ID NO: 387 - DNA, 327 bp, Mus musculus; identical to SEQ ID NO: 51

SEQ ID NO: 388 - protein, 109 aa, Mus musculus; identical to SEQ ID NO: 52

SEQ ID NO: 389 - DNA, 21 bp, Mus musculus
acttctggtatgggtgtgagc

SEQ ID NO: 390 - protein, 7 aa, Mus musculus
TSGMGVS

SEQ ID NO: 391 - DNA, 48 bp, Mus musculus; identical to SEQ ID NO: 39

SEQ ID NO: 392 - protein, 16 aa, Mus musculus
HIYWDDDKRYNPSLKS

SEQ ID NO: 393 - DNA, 21 bp, Mus musculus
ctgtatggtaacattgcttac

SEQ ID NO: 394 - protein, 7 aa, Mus musculus
LYGNIAY

SEQ ID NO: 395 - DNA, 48 bp, Mus musculus; identical to SEQ ID NO: 27

SEQ ID NO: 396 - protein, 16 aa, Mus musculus
RSSQSIVHSNGNTYLE

SEQ ID NO: 397 - DNA, 21 bp, Mus musculus
aaagtttccaaccgattttct

SEQ ID NO: 398 - protein, 7 aa, Mus musculus
KVSNRFS

SEQ ID NO: 399 - DNA, 27 bp, Mus musculus
tttcaaggttcacatgttccgctcacg

SEQ ID NO: 400 - protein, 9 aa, Mus musculus
FQGSHVPLT

SEQ ID NO: 401 - DNA, 417 bp, Mus musculus
atgggcaggcttacttcttcattcctgctactgattgtccctgcatatgtcctgtcccaggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgaatagggagaactacggggaacttcgatgtctggggcgcagggaccacggtcaccgtctcctca

SEQ ID NO: 402 - protein, 139 aa, Mus musculus
MGRLTSSFLLLIVPAYVLSQVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIGRTTGNFDVWGAGTTVTVSS

SEQ ID NO: 403 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgatcttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaa

SEQ ID NO: 404 - protein, 109 aa, Mus musculus
MTQTPLSLPVSLGDQASISCRSSQSLVHSNGNTYLHWYLQKPGQSPKLLIYKVSNRSSGVPDRFSGSGSGTDFTLKISRVEAEDLGVYFCSQSTHVPPTFGGGTKLEIK

SEQ ID NO: 405 - DNA, 21 bp, Mus musculus
acttctggtatgggtgtaggc

SEQ ID NO: 406 - protein, 7 aa, Mus musculus
TSGMGVG

SEQ ID NO: 407 - DNA, 48 bp, Mus musculus
cacatttggtgggatgatgtcaagcgctataacccagccctgaagagc

SEQ ID NO: 408 - protein, 16 aa, Mus musculus
HIWWDDVKRYNPALKS

SEQ ID NO: 409 - DNA, 30 bp, Mus musculus
atagggagaactacggggaacttcgatgtc

SEQ ID NO: 410 - protein, 10 aa, Mus musculus
IGRTTGNFDV

SEQ ID NO: 411 - DNA, 48 bp, Mus musculus; identical to SEQ ID NO: 43

SEQ ID NO: 412 - protein, 16 aa, Mus musculus
RSSQSLVHSNGNTYLH

SEQ ID NO: 413 - DNA, 21 bp, Mus musculus
aaagtttccaaccgatcttct

SEQ ID NO: 414 - protein, 7 aa, Mus musculus
KVSNRSS

SEQ ID NO: 415 - DNA, 27 bp, Mus musculus
tctcaaagtacacatgttcctccgacg

SEQ ID NO: 416 - protein, 9 aa, Mus musculus
SQSTHVPPT

SEQ ID NO: 417 - DNA, 312 bp, Mus musculus
atgaagcctggggcctcagtgaagatatcctgcaaggctactggctacacattcagtagctactggatagagtgggtaaagcagaggcctggacatggccttgagtggattggagacattttacctggaattggtactactaactacaatgagaagttcaagggcaaggccacattcactgcagatacatcctccaacacagcctacatgcaactcagcagcctgacatctgaggactctgccgtctattactgtgcaagtacgggaccggttgactactggggccaaggcaccactctcagagtctcctca

SEQ ID NO: 418 - protein, 104 aa, Mus musculus
MKPGASVKISCKATGYTFSSYWIEWVKQRPGHGLEWIGDILPGIGTTNYNEKFKGKATFTADTSSNTAYMQLSSLTSEDSAVYYCASTGPVDYWGQGTTLRVSS

SEQ ID NO: 419 - DNA, 327 bp, Mus musculus
atgacccagactccactcactttgtcggttaccattggacaaccagcctctatctcttgcaagtcaagtcagagcctcttatatagtaatggaaaaacctatttgaattggttattacagaggccaggccagtctccaaagcgcctaatctatctggtgtctaaactggactctggagtccctgacaggttcactggcagtggatcaggaacagattttacactgaaaatcagcagagtggaggctgaggatttgggagtttattactgcgtgcaaggtacacattttccattcatgttcggctcggggacaaagttggaaataaaa

SEQ ID NO: 420 - protein, 109 aa, Mus musculus
MTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPFMFGSGTKLEIK

SEQ ID NO: 421 - DNA, 15 bp, Mus musculus
agctactggatagag

SEQ ID NO: 422 - protein, 5 aa, Mus musculus
SYWIE

SEQ ID NO: 423 - DNA, 51 bp, Mus musculus
gacattttacctggaattggtactactaactacaatgagaagttcaagggc

SEQ ID NO: 424 - protein, 17 aa, Mus musculus
DILPGIGTTNYNEKFKG

SEQ ID NO: 425 - DNA, 18 bp, Mus musculus
acgggaccggttgactac

SEQ ID NO: 426 - protein, 6 aa, Mus musculus
TGPVDY

SEQ ID NO: 427 - DNA, 48 bp, Mus musculus
aagtcaagtcagagcctcttatatagtaatggaaaaacctatttgaat

SEQ ID NO: 428 - protein, 16 aa, Mus musculus
KSSQSLLYSNGKTYLN

SEQ ID NO: 429 - DNA, 21 bp, Mus musculus
ctggtgtctaaactggactct

SEQ ID NO: 430 - protein, 7 aa, Mus musculus
LVSKLDS

SEQ ID NO: 431 - DNA, 27 bp, Mus musculus
gtgcaaggtacacattttccattcatg

SEQ ID NO: 432 - protein, 9 aa, Mus musculus
VQGTHFPFM

SEQ ID NO: 433 - DNA, 417 bp, Mus musculus; identical to SEQ ID NO: 401

SEQ ID NO: 434 - protein, 139 aa, Mus musculus; identical to SEQ ID NO: 402

SEQ ID NO: 435 - DNA, 327 bp, Mus musculus; identical to SEQ ID NO: 339

SEQ ID NO: 436 - protein, 109 aa, Mus musculus; identical to SEQ ID NO: 340

SEQ ID NO: 437 - DNA, 21 bp, Mus musculus
acttctggtatgggtgtaggc

SEQ ID NO: 438 - protein, 7 aa, Mus musculus
TSGMGVG

SEQ ID NO: 439 - DNA, 48 bp, Mus musculus; identical to SEQ ID NO: 407

SEQ ID NO: 440 - protein, 16 aa, Mus musculus
HIWWDDVKRYNPALKS

SEQ ID NO: 441 - DNA, 30 bp, Mus musculus; identical to SEQ ID NO: 409

SEQ ID NO: 442 - protein, 10 aa, Mus musculus
IGRTTGNFDV

SEQ ID NO: 443 - DNA, 48 bp, Mus musculus; identical to SEQ ID NO: 43

SEQ ID NO: 444 - protein, 16 aa, Mus musculus
RSSQSLVHSNGNTYLH

SEQ ID NO: 445 - DNA, 21 bp, Mus musculus
aaagtttccaaccgattttct

SEQ ID NO: 446 - protein, 7 aa, Mus musculus
KVSNRFS

SEQ ID NO: 447 - DNA, 27 bp, Mus musculus
tctcaaagtacacatgttcctccgacg

SEQ ID NO: 448 - protein, 9 aa, Mus musculus
SQSTHVPPT

SEQ ID NO: 449 - DNA, 408 bp, Mus musculus
atgaacaggcttgcttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgatatggtaacgggtttgcttactggggccaagggactctggtcactgtctctgca

SEQ ID NO: 450 - protein, 136 aa, Mus musculus
MNRLASSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGNGFAYWGQGTLVTVSA

SEQ ID NO: 451 - DNA, 327 bp, Mus musculus; identical to SEQ ID NO: 195

SEQ ID NO: 452 - protein, 109 aa, Mus musculus; identical to SEQ ID NO: 52

SEQ ID NO: 453 - DNA, 21 bp, Mus musculus
acttctggtatgggtgtgagc

SEQ ID NO: 454 - protein, 7 aa, Mus musculus
TSGMGVS

SEQ ID NO: 455 - DNA, 48 bp, Mus musculus; identical to SEQ ID NO: 39

SEQ ID NO: 456 - protein, 16 aa, Mus musculus
HIYWDDDKRYNPSLKS

SEQ ID NO: 457 - DNA, 21 bp, Mus musculus
tatggtaacgggtttgcttac

SEQ ID NO: 458 - protein, 7 aa, Mus musculus
YGNGFAY

SEQ ID NO: 459 - DNA, 48 bp, Mus musculus; identical to SEQ ID NO: 27

SEQ ID NO: 460 - protein, 16 aa, Mus musculus
RSSQSIVHSNGNTYLE

SEQ ID NO: 461 - DNA, 21 bp, Mus musculus
aaagtttccaaccgattttct

SEQ ID NO: 462 - protein, 7 aa, Mus musculus
KVSNRFS

SEQ ID NO: 463 - DNA, 27 bp, Mus musculus
tttcaaggttcacatgttccgctcacg

SEQ ID NO: 464 - protein, 9 aa, Mus musculus
FQGSHVPLT

SEQ ID NO: 465 - DNA, 429 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctaattactacggctacggaatggatgctatggactactggggtcaaggaacctcagtcaccgtctcctca

SEQ ID NO: 466 - protein, 143 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRANYYGYGMDAMDYWGQGTSVTVSS

SEQ ID NO: 467 - DNA, 327 bp, Mus musculus; identical to SEQ ID NO: 195

SEQ ID NO: 468 - protein, 109 aa, Mus musculus; identical to SEQ ID NO: 52

SEQ ID NO: 469 - DNA, 21 bp, Mus musculus
acttctggtatgggtgtgagc

SEQ ID NO: 470 - protein, 7 aa, Mus musculus
TSGMGVS

SEQ ID NO: 471 - DNA, 48 bp, Mus musculus; identical to SEQ ID NO: 39

SEQ ID NO: 472 - protein, 16 aa, Mus musculus
HIYWDDDKRYNPSLKS

SEQ ID NO: 473 - DNA, 42 bp, Mus musculus
agagctaattactacggctacggaatggatgctatggactac

SEQ ID NO: 474 - protein, 14 aa, Mus musculus
RANYYGYGMDAMDY

SEQ ID NO: 475 - DNA, 48 bp, Mus musculus; identical to SEQ ID NO: 27

SEQ ID NO: 476 - protein, 16 aa, Mus musculus
RSSQSIVHSNGNTYLE

SEQ ID NO: 477 - DNA, 21 bp, Mus musculus
aaagtttccaaccgattttct

SEQ ID NO: 478 - protein, 7 aa, Mus musculus
KVSNRFS

SEQ ID NO: 479 - DNA, 27 bp, Mus musculus
tttcaaggttcacatgttccgctcacg

SEQ ID NO: 480 - protein, 9 aa, Mus musculus
FQGSHVPLT

SEQ ID NO: 481 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgggactatggactactggggtcaaggaacctcagtcaccgtctcctca

SEQ ID NO: 482 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGTMDYWGQGTSVTVSS

SEQ ID NO: 483 - DNA, 327 bp, Mus musculus
atgacccaaactccactctccctgcctgtcagtcttggagatcaagcctccatctcttgcaggtctagtcagagccttgaaaacagtaatggaaacacctatttgaactggtacctccagaaaccaggccagtctccacagctcctgatctacagggtttccaaccgattttctggggtcctagacaggttcagtggtagtggatcagggacagatttcacactgaaaatcagcagagtggaggctgaggatttgggagtttatttctgcctccaagttacacatgtccctccgacgttcggtggaggcaccaagctggaaatcaaa

SEQ ID NO: 484 - protein, 109 aa, Mus musculus
MTQTPLSLPVSLGDQASISCRSSQSLENSNGNTYLNWYLQKPGQSPQLLIYRVSNRFSGVLDRFSGSGSGTDFTLKISRVEAEDLGVYFCLQVTHVPPTFGGGTKLEIK

SEQ ID NO: 485 - DNA, 15 bp, Mus musculus
agctttggaatgcac

SEQ ID NO: 486 - protein, 5 aa, Mus musculus
SFGMH

SEQ ID NO: 487 - DNA, 51 bp, Mus musculus; identical to SEQ ID NO: 119

SEQ ID NO: 488 - protein, 17 aa, Mus musculus
YISSGSSTIYYADTVKG

SEQ ID NO: 489 - DNA, 18 bp, Mus musculus
gatgggactatggactac

SEQ ID NO: 490 - protein, 6 aa, Mus musculus
DGTMDY

SEQ ID NO: 491 - DNA, 48 bp, Mus musculus
aggtctagtcagagccttgaaaacagtaatggaaacacctatttgaac

SEQ ID NO: 492 - protein, 16 aa, Mus musculus
RSSQSLENSNGNTYLN

SEQ ID NO: 493 - DNA, 21 bp, Mus musculus
agggtttccaaccgattttct

SEQ ID NO: 494 - protein, 7 aa, Mus musculus
RVSNRFS

SEQ ID NO: 495 - DNA, 27 bp, Mus musculus
ctccaagttacacatgtccctccgacg

SEQ ID NO: 496 - protein, 9 aa, Mus musculus
LQVTHVPPT

SEQ ID NO: 497 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgagggattacgacggggtttgcttactggggccaagggactctggtcactgtctctgca

SEQ ID NO: 498 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGITTGFAYWGQGTLVTVSA

SEQ ID NO: 499 - DNA, 327 bp, Mus musculus; identical to SEQ ID NO: 195

SEQ ID NO: 500 - protein, 109 aa, Mus musculus; identical to SEQ ID NO: 52

SEQ ID NO: 501 - DNA, 21 bp, Mus musculus
acttctggtatgggtgtgagc

SEQ ID NO: 502 - protein, 7 aa, Mus musculus
TSGMGVS

SEQ ID NO: 503 - DNA, 48 bp, Mus musculus; identical to SEQ ID NO: 39

SEQ ID NO: 504 - protein, 16 aa, Mus musculus
HIYWDDDKRYNPSLKS

SEQ ID NO: 505 - DNA, 24 bp, Mus musculus
gggattacgacggggtttgcttac

SEQ ID NO: 506 - protein, 8 aa, Mus musculus
GITTGFAY

SEQ ID NO: 507 - DNA, 48 bp, Mus musculus; identical to SEQ ID NO: 27

SEQ ID NO: 508 - protein, 16 aa, Mus musculus
RSSQSIVHSNGNTYLE

SEQ ID NO: 509 - DNA, 21 bp, Mus musculus
aaagtttccaaccgattttct

SEQ ID NO: 510 - protein, 7 aa, Mus musculus
KVSNRFS

SEQ ID NO: 511 - DNA, 27 bp, Mus musculus
tttcaaggttcacatgttccgctcacg

SEQ ID NO: 512 - protein, 9 aa, Mus musculus
FQGSHVPLT

SEQ ID NO: 513 - DNA, 423 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgacgtagacagctcgggctacgtgatgctatggactactggggtcaaggaacctcagtcaccgtctcctca

SEQ ID NO: 514 - protein, 141 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRQLGLRDAMDYWGQGTSVTVSS

SEQ ID NO: 515 - DNA, 327 bp, Mus musculus; identical to SEQ ID NO: 51

SEQ ID NO: 516 - protein, 109 aa, Mus musculus; identical to SEQ ID NO: 52

SEQ ID NO: 517 - DNA, 21 bp, Mus musculus
acttctggtatgggtgtgagc

SEQ ID NO: 518 - protein, 7 aa, Mus musculus
TSGMGVS

SEQ ID NO: 519 - DNA, 48 bp, Mus musculus; identical to SEQ ID NO: 39

SEQ ID NO: 520 - protein, 16 aa, Mus musculus
HIYWDDDKRYNPSLKS

SEQ ID NO: 521 - DNA, 36 bp, Mus musculus
cgtagacagctcgggctacgtgatgctatggactac

SEQ ID NO: 522 - protein, 12 aa, Mus musculus
RRQLGLRDAMDY

SEQ ID NO: 523 - DNA, 48 bp, Mus musculus; identical to SEQ ID NO: 27

SEQ ID NO: 524 - protein, 16 aa, Mus musculus
RSSQSIVHSNGNTYLE

SEQ ID NO: 525 - DNA, 21 bp, Mus musculus
aaagtttccaaccgattttct

SEQ ID NO: 526 - protein, 7 aa, Mus musculus
KVSNRFS

SEQ ID NO: 527 - DNA, 27 bp, Mus musculus
tttcaaggttcacatgttccgctcacg

SEQ ID NO: 528 - protein, 9 aa, Mus musculus
FQGSHVPLT

SEQ ID NO: 529 - DNA, 417 bp, Mus musculus; identical to SEQ ID NO: 401

SEQ ID NO: 530 - protein, 139 aa, Mus musculus; identical to SEQ ID NO: 402

SEQ ID NO: 531 - DNA, 327 bp, Mus musculus; identical to SEQ ID NO: 339

SEQ ID NO: 532 - protein, 109 aa, Mus musculus; identical to SEQ ID NO: 340

SEQ ID NO: 533 - DNA, 21 bp, Mus musculus
acttctggtatgggtgtaggc

SEQ ID NO: 534 - protein, 7 aa, Mus musculus
TSGMGVG

SEQ ID NO: 535 - DNA, 48 bp, Mus musculus; identical to SEQ ID NO: 407

SEQ ID NO: 536 - protein, 16 aa, Mus musculus
HIWWDDVKRYNPALKS

SEQ ID NO: 537 - DNA, 30 bp, Mus musculus; identical to SEQ ID NO: 409

SEQ ID NO: 538 - protein, 10 aa, Mus musculus
IGRTTGNFDV

SEQ ID NO: 539 - DNA, 48 bp, Mus musculus; identical to SEQ ID NO: 43

SEQ ID NO: 540 - protein, 16 aa, Mus musculus
RSSQSLVHSNGNTYLH

SEQ ID NO: 541 - DNA, 21 bp, Mus musculus
aaagtttccaaccgattttct

SEQ ID NO: 542 - protein, 7 aa, Mus musculus
KVSNRFS

SEQ ID NO: 543 - DNA, 27 bp, Mus musculus
tctcaaagtacacatgttcctccgacg

SEQ ID NO: 544 - protein, 9 aa, Mus musculus
SQSTHVPPT

SEQ ID NO: 545 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagggggtactatgccctctcttactggggccaagggactctggtcactgtctctgca

SEQ ID NO: 546 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGYYALSYWGQGTLVTVSA

SEQ ID NO: 547 - DNA, 327 bp, Mus musculus; identical to SEQ ID NO: 195

SEQ ID NO: 548 - protein, 109 aa, Mus musculus; identical to SEQ ID NO: 52

SEQ ID NO: 549 - DNA, 21 bp, Mus musculus
acttctggtatgggtgtgagc

SEQ ID NO: 550 - protein, 7 aa, Mus musculus
TSGMGVS

SEQ ID NO: 551 - DNA, 48 bp, Mus musculus; identical to SEQ ID NO: 39

SEQ ID NO: 552 - protein, 16 aa, Mus musculus
HIYWDDDKRYNPSLKS

SEQ ID NO: 553 - DNA, 24 bp, Mus musculus
agggggtactatgccctctcttac

SEQ ID NO: 554 - protein, 8 aa, Mus musculus
RGYYALSY

SEQ ID NO: 555 - DNA, 48 bp, Mus musculus; identical to SEQ ID NO: 27

SEQ ID NO: 556 - protein, 16 aa, Mus musculus
RSSQSIVHSNGNTYLE

SEQ ID NO: 557 - DNA, 21 bp, Mus musculus
aaagtttccaaccgattttct

SEQ ID NO: 558 - protein, 7 aa, Mus musculus
KVSNRFS

SEQ ID NO: 559 - DNA, 27 bp, Mus musculus
tttcaaggttcacatgttccgctcacg

SEQ ID NO: 560 - protein, 9 aa, Mus musculus
FQGSHVPLT

SEQ ID NO: 561 - DNA, 417 bp, Mus musculus; identical to SEQ ID NO: 353

SEQ ID NO: 562 - protein, 139 aa, Mus musculus; identical to SEQ ID NO: 354

SEQ ID NO: 563 - DNA, 327 bp, Mus musculus; identical to SEQ ID NO: 51

SEQ ID NO: 564 - protein, 109 aa, Mus musculus; identical to SEQ ID NO: 52

SEQ ID NO: 565 - DNA, 21 bp, Mus musculus
acttctggtatgggtgtgagc

SEQ ID NO: 566 - protein, 7 aa, Mus musculus
TSGMGVS

SEQ ID NO: 567 - DNA, 48 bp, Mus musculus; identical to SEQ ID NO: 39

SEQ ID NO: 568 - protein, 16 aa, Mus musculus
HIYWDDDKRYNPSLKS

SEQ ID NO: 569 - DNA, 30 bp, Mus musculus; identical to SEQ ID NO: 361

SEQ ID NO: 570 - protein, 10 aa, Mus musculus
RGLKKDYFDY

SEQ ID NO: 571 - DNA, 48 bp, Mus musculus; identical to SEQ ID NO: 27

SEQ ID NO: 572 - protein, 16 aa, Mus musculus
RSSQSIVHSNGNTYLE

SEQ ID NO: 573 - DNA, 21 bp, Mus musculus
aaagtttccaaccgattttct

SEQ ID NO: 574 - protein, 7 aa, Mus musculus
KVSNRFS

SEQ ID NO: 575 - DNA, 27 bp, Mus musculus
tttcaaggttcacatgttccgctcacg

SEQ ID NO: 576 - protein, 9 aa, Mus musculus
FQGSHVPLT

SEQ ID NO: 577 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagggcttcgagggggactgatgctatggactactggggtcaaggaacctcagtcaccgtctcctca

SEQ ID NO: 578 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRASRGTDAMDYWGQGTSVTVSS

SEQ ID NO: 579 - DNA, 327 bp, Mus musculus; identical to SEQ ID NO: 51

SEQ ID NO: 580 - protein, 109 aa, Mus musculus; identical to SEQ ID NO: 52

SEQ ID NO: 581 - DNA, 21 bp, Mus musculus
acttctggtatgggtgtaggc

SEQ ID NO: 582 - protein, 7 aa, Mus musculus
TSGMGVG

SEQ ID NO: 583 - DNA, 48 bp, Mus musculus; identical to SEQ ID NO: 103

SEQ ID NO: 584 - protein, 16 aa, Mus musculus
HIWWDDDKYYNPSLKS

SEQ ID NO: 585 - DNA, 33 bp, Mus musculus
agggcttcgagggggactgatgctatggactac

SEQ ID NO: 586 - protein, 11 aa, Mus musculus
RASRGTDAMDY

SEQ ID NO: 587 - DNA, 48 bp, Mus musculus; identical to SEQ ID NO: 27

SEQ ID NO: 588 - protein, 16 aa, Mus musculus
RSSQSIVHSNGNTYLE

SEQ ID NO: 589 - DNA, 21 bp, Mus musculus
aaagtttccaaccgattttct

SEQ ID NO: 590 - protein, 7 aa, Mus musculus
KVSNRFS

SEQ ID NO: 591 - DNA, 27 bp, Mus musculus
tttcaaggttcacatgttccgctcacg

SEQ ID NO: 592 - protein, 9 aa, Mus musculus
FQGSHVPLT

SEQ ID NO: 593 - DNA, 411 bp, Mus musculus
atgagagtgctgattcttttgtgcctgttcacagcctttcctggtatcctgtctgatgtgcagcttcaggagtcaggacctgacctggtgaaaccttctcagtcactttcactcacctgcactgtcactggctactccatcaccagtggttatagctggcactggatccggcagtttccaggaaacaaactggaatggatgggctacatacactacagtggtagcactaactacaacccatctctcaaaagtcgaatctctatcactcgagacacatccaagaaccagttcttcctgcagttgaattctgtgactactgaggacacagccacatattactgtgcaagatacctttattactacggtagtagctacgagtggggccaaggcaccactctcacagtctcctca

SEQ ID NO: 594 - protein, 137 aa, Mus musculus
MRVLILLCLFTAFPGILSDVQLQESGPDLVKPSQSLSLTCTVTGYSITSGYSWHWIRQFPGNKLEWMGYIHYSGSTNYNPSLKSRISITRDTSKNQFFLQLNSVTTEDTATYYCARYLYYYGSSYEWGQGTTLTVSS

SEQ ID NO: 595 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaa

SEQ ID NO: 596 - protein, 109 aa, Mus musculus
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 597 - DNA, 18 bp, Mus musculus
agtggttatagctggcac

SEQ ID NO: 598 - protein, 6 aa, Mus musculus
SGYSWH

SEQ ID NO: 599 - DNA, 48 bp, Mus musculus
tacatacactacagtggtagcactaactacaacccatctctcaaaagt

SEQ ID NO: 600 - protein, 16 aa, Mus musculus
YIHYSGSTNYNPSLKS

SEQ ID NO: 601 - DNA, 30 bp, Mus musculus
tacctttattactacggtagtagctacgag

SEQ ID NO: 602 - protein, 10 aa, Mus musculus
YLYYYGSSYE

SEQ ID NO: 603 - DNA, 48 bp, Mus musculus; identical to SEQ ID NO: 43

SEQ ID NO: 604 - protein, 16 aa, Mus musculus
RSSQSLVHSNGNTYLH

SEQ ID NO: 605 - DNA, 21 bp, Mus musculus
aaagtttccaaccgattttct

SEQ ID NO: 606 - protein, 7 aa, Mus musculus
KVSNRFS

SEQ ID NO: 607 - DNA, 27 bp, Mus musculus
tctcaaagtacacatgttccgtggacg

SEQ ID NO: 608 - protein, 9 aa, Mus musculus
SQSTHVPWT

SEQ ID NO: 609 - DNA, 423 bp, Mus musculus; identical to SEQ ID NO: 513

SEQ ID NO: 610 - protein, 141 aa, Mus musculus; identical to SEQ ID NO: 514

SEQ ID NO: 611 - DNA, 327 bp, Mus musculus; identical to SEQ ID NO: 195

SEQ ID NO: 612 - protein, 109 aa, Mus musculus; identical to SEQ ID NO: 52

SEQ ID NO: 613 - DNA, 21 bp, Mus musculus
acttctggtatgggtgtgagc

SEQ ID NO: 614 - protein, 7 aa, Mus musculus
TSGMGVS

SEQ ID NO: 615 - DNA, 48 bp, Mus musculus; identical to SEQ ID NO: 39

SEQ ID NO: 616 - protein, 16 aa, Mus musculus
HIYWDDDKRYNPSLKS

SEQ ID NO: 617 - DNA, 36 bp, Mus musculus; identical to SEQ ID NO: 521

SEQ ID NO: 618 - protein, 12 aa, Mus musculus
RRQLGLRDAMDY

SEQ ID NO: 619 - DNA, 48 bp, Mus musculus; identical to SEQ ID NO: 27

SEQ ID NO: 620 - protein, 16 aa, Mus musculus
RSSQSIVHSNGNTYLE

SEQ ID NO: 621 - DNA, 21 bp, Mus musculus
aaagtttccaaccgattttct

SEQ ID NO: 622 - protein, 7 aa, Mus musculus
KVSNRFS

SEQ ID NO: 623 - DNA, 27 bp, Mus musculus
tttcaaggttcacatgttccgctcacg

SEQ ID NO: 624 - protein, 9 aa, Mus musculus
FQGSHVPLT

SEQ ID NO: 625 - DNA, 420 bp, Mus musculus
atggacaggcttacttcttcattcctgctgctgattgcccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaaacctttataggtacgacctctttgactactggggccaaggcaccactctcacagtctcctca

SEQ ID NO: 626 - protein, 140 aa, Mus musculus
MDRLTSSFLLLIAPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRNLYRYDLFDYWGQGTTLTVSS

SEQ ID NO: 627 - DNA, 327 bp, Mus musculus; identical to SEQ ID NO: 195

SEQ ID NO: 628 - protein, 109 aa, Mus musculus; identical to SEQ ID NO: 52

SEQ ID NO: 629 - DNA, 21 bp, Mus musculus
acttctggtatgggtgtaggc

SEQ ID NO: 630 - protein, 7 aa, Mus musculus
TSGMGVG

SEQ ID NO: 631 - DNA, 48 bp, Mus musculus; identical to SEQ ID NO: 103

SEQ ID NO: 632 - protein, 16 aa, Mus musculus
HIWWDDDKYYNPSLKS

SEQ ID NO: 633 - DNA, 33 bp, Mus musculus
agaaacctttataggtacgacctctttgactac

SEQ ID NO: 634 - protein, 11 aa, Mus musculus
RNLYRYDLFDY

SEQ ID NO: 635 - DNA, 48 bp, Mus musculus; identical to SEQ ID NO: 27

SEQ ID NO: 636 - protein, 16 aa, Mus musculus
RSSQSIVHSNGNTYLE

SEQ ID NO: 637 - DNA, 21 bp, Mus musculus
aaagtttccaaccgattttct

SEQ ID NO: 638 - protein, 7 aa, Mus musculus
KVSNRFS

SEQ ID NO: 639 - DNA, 27 bp, Mus musculus
tttcaaggttcacatgttccgctcacg

SEQ ID NO: 640 - protein, 9 aa, Mus musculus
FQGSHVPLT

SEQ ID NO: 641 - DNA, 417 bp, Mus musculus; identical to SEQ ID NO: 353

SEQ ID NO: 642 - protein, 139 aa, Mus musculus; identical to SEQ ID NO: 354

SEQ ID NO: 643 - DNA, 327 bp, Mus musculus; identical to SEQ ID NO: 195

SEQ ID NO: 644 - protein, 109 aa, Mus musculus; identical to SEQ ID NO: 52

SEQ ID NO: 645 - DNA, 21 bp, Mus musculus
acttctggtatgggtgtgagc

SEQ ID NO: 646 - protein, 7 aa, Mus musculus
TSGMGVS

SEQ ID NO: 647 - DNA, 48 bp, Mus musculus; identical to SEQ ID NO: 39

SEQ ID NO: 648 - protein, 16 aa, Mus musculus
HIYWDDDKRYNPSLKS

SEQ ID NO: 649 - DNA, 30 bp, Mus musculus; identical to SEQ ID NO: 361

SEQ ID NO: 650 - protein, 10 aa, Mus musculus
RGLKKDYFDY

SEQ ID NO: 651 - DNA, 48 bp, Mus musculus; identical to SEQ ID NO: 27

SEQ ID NO: 652 - protein, 16 aa, Mus musculus
RSSQSIVHSNGNTYLE

SEQ ID NO: 653 - DNA, 21 bp, Mus musculus
aaagtttccaaccgattttct

SEQ ID NO: 654 - protein, 7 aa, Mus musculus
KVSNRFS

SEQ ID NO: 655 - DNA, 27 bp, Mus musculus
tttcaaggttcacatgttccgctcacg

SEQ ID NO: 656 - protein, 9 aa, Mus musculus
FQGSHVPLT

SEQ ID NO: 657 - DNA, 414 bp, Mus musculus; identical to SEQ ID NO: 321

SEQ ID NO: 658 - protein, 138 aa, Mus musculus; identical to SEQ ID NO: 322

SEQ ID NO: 659 - DNA, 327 bp, Mus musculus; identical to SEQ ID NO: 243

SEQ ID NO: 660 - protein, 109 aa, Mus musculus; identical to SEQ ID NO: 244

SEQ ID NO: 661 - DNA, 15 bp, Mus musculus
agctttggaatgcac

SEQ ID NO: 662 - protein, 5 aa, Mus musculus
SFGMH

SEQ ID NO: 663 - DNA, 51 bp, Mus musculus; identical to SEQ ID NO: 119

SEQ ID NO: 664 - protein, 17 aa, Mus musculus
YISSGSSTIYYADTVKG

SEQ ID NO: 665 - DNA, 30 bp, Mus musculus; identical to SEQ ID NO: 329

SEQ ID NO: 666 - protein, 10 aa, Mus musculus
GYRYDEGFAY

SEQ ID NO: 667 - DNA, 48 bp, Mus musculus; identical to SEQ ID NO: 27

SEQ ID NO: 668 - protein, 16 aa, Mus musculus
RSSQSIVHSNGNTYLE

SEQ ID NO: 669 - DNA, 21 bp, Mus musculus
aaagtttccaaccgattttct

SEQ ID NO: 670 - protein, 7 aa, Mus musculus
KVSNRFS

SEQ ID NO: 671 - DNA, 27 bp, Mus musculus
tttcaaggttcacatgttcctccgacg

SEQ ID NO: 672 - protein, 9 aa, Mus musculus
FQGSHVPPT

SEQ ID NO: 673 - DNA, 411 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaaacactataacccatccctgaagagtcggctcacaatctccaaggatacctccagcaaccagttattcctcaagatcaccagtgtggacactgcagatactgccacatactactgtgctcgctatgtttacgactcgtttgcttactggggccaagggactctggtcactgtctctgca

SEQ ID NO: 674 - protein, 137 aa, Mus musculus
MNRLTSSLLLLIVPAYVLSQVTLKESGPGILQPSQTLSLTCSFSGFSLSTSGMGVSWIRQPSGKGLEWLAHIYWDDDKHYNPSLKSRLTISKDTSSNQLFLKITSVDTADTATYYCARYVYDSFAYWGQGTLVTVSA

SEQ ID NO: 675 - DNA, 327 bp, Mus musculus; identical to SEQ ID NO: 51

SEQ ID NO: 676 - protein, 109 aa, Mus musculus; identical to SEQ ID NO: 52

SEQ ID NO: 677 - DNA, 21 bp, Mus musculus
acttctggtatgggtgtgagc

SEQ ID NO: 678 - protein, 7 aa, Mus musculus
TSGMGVS

SEQ ID NO: 679 - DNA, 48 bp, Mus musculus
cacatttactgggatgatgacaaacactataacccatccctgaagagt

SEQ ID NO: 680 - protein, 16 aa, Mus musculus
HIYWDDDKHYNPSLKS

SEQ ID NO: 681 - DNA, 24 bp, Mus musculus
tatgtttacgactcgtttgcttac

SEQ ID NO: 682 - protein, 8 aa, Mus musculus
YVYDSFAY

SEQ ID NO: 683 - DNA, 48 bp, Mus musculus; identical to SEQ ID NO: 27

SEQ ID NO: 684 - protein, 16 aa, Mus musculus
RSSQSIVHSNGNTYLE

SEQ ID NO: 685 - DNA, 21 bp, Mus musculus
aaagtttccaaccgattttct

SEQ ID NO: 686 - protein, 7 aa, Mus musculus
KVSNRFS

SEQ ID NO: 687 - DNA, 27 bp, Mus musculus
tttcaaggttcacatgttccgctcacg

SEQ ID NO: 688 - protein, 9 aa, Mus musculus
FQGSHVPLT

SEQ ID NO: 689 - DNA, 423 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaacgacagctcgggctagagactactttgactactggggccaaggcaccactctcacagtctcctca

SEQ ID NO: 690 - protein, 141 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRTTARARDYFDYWGQGTTLTVSS

SEQ ID NO: 691 - DNA, 327 bp, Mus musculus; identical to SEQ ID NO: 51

SEQ ID NO: 692 - protein, 109 aa, Mus musculus; identical to SEQ ID NO: 52

SEQ ID NO: 693 - DNA, 21 bp, Mus musculus
acttctggtatgggtgtaggc

SEQ ID NO: 694 - protein, 7 aa, Mus musculus
TSGMGVG

SEQ ID NO: 695 - DNA, 48 bp, Mus musculus; identical to SEQ ID NO: 103

SEQ ID NO: 696 - protein, 16 aa, Mus musculus
HIWWDDDKYYNPSLKS

SEQ ID NO: 697 - DNA, 36 bp, Mus musculus
agaacgacagctcgggctagagactactttgactac

SEQ ID NO: 698 - protein, 12 aa, Mus musculus
RTTARARDYFDY

SEQ ID NO: 699 - DNA, 48 bp, Mus musculus; identical to SEQ ID NO: 27

SEQ ID NO: 700 - protein, 16 aa, Mus musculus
RSSQSIVHSNGNTYLE

SEQ ID NO: 701 - DNA, 21 bp, Mus musculus
aaagtttccaaccgattttct

SEQ ID NO: 702 - protein, 7 aa, Mus musculus
KVSNRFS

SEQ ID NO: 703 - DNA, 27 bp, Mus musculus
tttcaaggttcacatgttccgctcacg

SEQ ID NO: 704 - protein, 9 aa, Mus musculus
FQGSHVPLT

SEQ ID NO: 705 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactacggtagaggtggggctatggactactggggtcaaggaacctcagtcaccgtctcctca

SEQ ID NO: 706 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGRGGAMDYWGQGTSVTVSS

SEQ ID NO: 707 - DNA, 327 bp, Mus musculus; identical to SEQ ID NO: 243

SEQ ID NO: 708 - protein, 109 aa, Mus musculus; identical to SEQ ID NO: 244

SEQ ID NO: 709 - DNA, 15 bp, Mus musculus
agctttggaatgcac

SEQ ID NO: 710 - protein, 5 aa, Mus musculus
SFGMH

SEQ ID NO: 711 - DNA, 51 bp, Mus musculus; identical to SEQ ID NO: 119

SEQ ID NO: 712 - protein, 17 aa, Mus musculus
YISSGSSTIYYADTVKG

SEQ ID NO: 713 - DNA, 30 bp, Mus musculus
tactacggtagaggtggggctatggactac

SEQ ID NO: 714 - protein, 10 aa, Mus musculus
YYGRGGAMDY

SEQ ID NO: 715 - DNA, 48 bp, Mus musculus; identical to SEQ ID NO: 27

SEQ ID NO: 716 - protein, 16 aa, Mus musculus
RSSQSIVHSNGNTYLE

SEQ ID NO: 717 - DNA, 21 bp, Mus musculus
aaagtttccaaccgattttct

SEQ ID NO: 718 - protein, 7 aa, Mus musculus
KVSNRFS

SEQ ID NO: 719 - DNA, 27 bp, Mus musculus
tttcaaggttcacatgttcctccgacg

SEQ ID NO: 720 - protein, 9 aa, Mus musculus
FQGSHVPPT

SEQ ID NO: 721 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggctataggtacttatttgactactggggccaaggcaccactctcacagtctcctca

SEQ ID NO: 722 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGYRYLFDYWGQGTTLTVSS

SEQ ID NO: 723 - DNA, 363 bp, Mus musculus
atgttctggattcctgcttccagcagtgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaa

SEQ ID NO: 724 - protein, 121 aa, Mus musculus
MFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 725 - DNA, 15 bp, Mus musculus
agctttggaatgcac

SEQ ID NO: 726 - protein, 5 aa, Mus musculus
SFGMH

SEQ ID NO: 727 - DNA, 51 bp, Mus musculus; identical to SEQ ID NO: 119

SEQ ID NO: 728 - protein, 17 aa, Mus musculus
YISSGSSTIYYADTVKG

SEQ ID NO: 729 - DNA, 27 bp, Mus musculus
gagggctataggtacttatttgactac

SEQ ID NO: 730 - protein, 9 aa, Mus musculus
EGYRYLFDY

SEQ ID NO: 731 - DNA, 48 bp, Mus musculus; identical to SEQ ID NO: 43

SEQ ID NO: 732 - protein, 16 aa, Mus musculus
RSSQSLVHSNGNTYLH

SEQ ID NO: 733 - DNA, 21 bp, Mus musculus
aaagtttccaaccgattttct

SEQ ID NO: 734 - protein, 7 aa, Mus musculus
KVSNRFS

SEQ ID NO: 735 - DNA, 27 bp, Mus musculus
tctcaaagtacacatgttccgtggacg

SEQ ID NO: 736 - protein, 9 aa, Mus musculus
SQSTHVPWT

SEQ ID NO: 737 - DNA, 417 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagctctatggtatccctggtttgcttactggggccaagggactctggtcactgtctctgca

SEQ ID NO: 738 - protein, 139 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRALWYPWFAYWGQGTLVTVSA

SEQ ID NO: 739 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggctcggggacaaagttggaaataaaa

SEQ ID NO: 740 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGSGTKLEIK

SEQ ID NO: 741 - DNA, 21 bp, Mus musculus
acttctggtatgggtgtgagc

SEQ ID NO: 742 - protein, 7 aa, Mus musculus
TSGMGVS

SEQ ID NO: 743 - DNA, 48 bp, Mus musculus; identical to SEQ ID NO: 39

SEQ ID NO: 744 - protein, 16 aa, Mus musculus
HIYWDDDKRYNPSLKS

SEQ ID NO: 745 - DNA, 30 bp, Mus musculus
agagctctatggtatccctggtttgcttac

SEQ ID NO: 746 - protein, 10 aa, Mus musculus
RALWYPWFAY

SEQ ID NO: 747 - DNA, 48 bp, Mus musculus; identical to SEQ ID NO: 27

SEQ ID NO: 748 - protein, 16 aa, Mus musculus
RSSQSIVHSNGNTYLE

SEQ ID NO: 749 - DNA, 21 bp, Mus musculus
aaagtttccaaccgattttct

SEQ ID NO: 750 - protein, 7 aa, Mus musculus
KVSNRFS

SEQ ID NO: 751 - DNA, 27 bp, Mus musculus
tttcaaggttcacatgttcctctcacg

SEQ ID NO: 752 - protein, 9 aa, Mus musculus
FQGSHVPLT

SEQ ID NO: 753 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagcacggagctacggtgctatggactactggggtcaaggaacctcagtcaccgtctcctca

SEQ ID NO: 754 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSARSYGAMDYWGQGTSVTVSS

SEQ ID NO: 755 - DNA, 327 bp, Mus musculus; identical to SEQ ID NO: 51

SEQ ID NO: 756 - protein, 109 aa, Mus musculus; identical to SEQ ID NO: 52

SEQ ID NO: 757 - DNA, 15 bp, Mus musculus
agctttggaatgcac

SEQ ID NO: 758 - protein, 5 aa, Mus musculus
SFGMH

SEQ ID NO: 759 - DNA, 51 bp, Mus musculus; identical to SEQ ID NO: 119

SEQ ID NO: 760 - protein, 17 aa, Mus musculus
YISSGSSTIYYADTVKG

SEQ ID NO: 761 - DNA, 30 bp, Mus musculus
tcagcacggagctacggtgctatggactac

SEQ ID NO: 762 - protein, 10 aa, Mus musculus
SARSYGAMDY

SEQ ID NO: 763 - DNA, 48 bp, Mus musculus; identical to SEQ ID NO: 27

SEQ ID NO: 764 - protein, 16 aa, Mus musculus
RSSQSIVHSNGNTYLE

SEQ ID NO: 765 - DNA, 21 bp, Mus musculus
aaagtttccaaccgattttct

SEQ ID NO: 766 - protein, 7 aa, Mus musculus
KVSNRFS

SEQ ID NO: 767 - DNA, 27 bp, Mus musculus
tttcaaggttcacatgttccgctcacg

SEQ ID NO: 768 - protein, 9 aa, Mus musculus
FQGSHVPLT

SEQ ID NO: 769 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaactatgctatggactactggggtcaaggaacctcagtcaccgtctcctca

SEQ ID NO: 770 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYAMDYWGQGTSVTVSS

SEQ ID NO: 771 - DNA, 327 bp, Mus musculus; identical to SEQ ID NO: 243

SEQ ID NO: 772 - protein, 109 aa, Mus musculus; identical to SEQ ID NO: 244

SEQ ID NO: 773 - DNA, 15 bp, Mus musculus
agctttggaatgcac

SEQ ID NO: 774 - protein, 5 aa, Mus musculus
SFGMH

SEQ ID NO: 775 - DNA, 51 bp, Mus musculus; identical to SEQ ID NO: 119

SEQ ID NO: 776 - protein, 17 aa, Mus musculus
YISSGSSTIYYADTVKG

SEQ ID NO: 777 - DNA, 24 bp, Mus musculus
tatggtaactatgctatggactac

SEQ ID NO: 778 - protein, 8 aa, Mus musculus
YGNYAMDY

SEQ ID NO: 779 - DNA, 48 bp, Mus musculus; identical to SEQ ID NO: 27

SEQ ID NO: 780 - protein, 16 aa, Mus musculus
RSSQSIVHSNGNTYLE

SEQ ID NO: 781 - DNA, 21 bp, Mus musculus
aaagtttccaaccgattttct

SEQ ID NO: 782 - protein, 7 aa, Mus musculus
KVSNRFS

SEQ ID NO: 783 - DNA, 27 bp, Mus musculus
tttcaaggttcacatgttcctccgacg

SEQ ID NO: 784 - protein, 9 aa, Mus musculus
FQGSHVPPT

SEQ ID NO: 785 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagggagggaaatatggactactggggtcaaggaacctcagtcaccgtctcctca

SEQ ID NO: 786 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGNMDYWGQGTSVTVSS

SEQ ID NO: 787 - DNA, 327 bp, Mus musculus; identical to SEQ ID NO: 339

SEQ ID NO: 788 - protein, 109 aa, Mus musculus; identical to SEQ ID NO: 340

SEQ ID NO: 789 - DNA, 15 bp, Mus musculus
agctttggaatgcac

SEQ ID NO: 790 - protein, 5 aa, Mus musculus
SFGMH

SEQ ID NO: 791 - DNA, 51 bp, Mus musculus; identical to SEQ ID NO: 119

SEQ ID NO: 792 - protein, 17 aa, Mus musculus
YISSGSSTIYYADTVKG

SEQ ID NO: 793 - DNA, 18 bp, Mus musculus
gagggaaatatggactac

SEQ ID NO: 794 - protein, 6 aa, Mus musculus
EGNMDY

SEQ ID NO: 795 - DNA, 48 bp, Mus musculus; identical to SEQ ID NO: 43

SEQ ID NO: 796 - protein, 16 aa, Mus musculus
RSSQSLVHSNGNTYLH

SEQ ID NO: 797 - DNA, 21 bp, Mus musculus
aaagtttccaaccgattttct

SEQ ID NO: 798 - protein, 7 aa, Mus musculus
KVSNRFS

SEQ ID NO: 799 - DNA, 27 bp, Mus musculus
tctcaaagtacacatgttcctccgacg

SEQ ID NO: 800 - protein, 9 aa, Mus musculus
SQSTHVPPT

SEQ ID NO: 801 - DNA, 411 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagaagagggtatggttacgactactggggccaaggcaccactctcacagtctcctca

SEQ ID NO: 802 - protein, 137 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRRGYGYDYWGQGTTLTVSS

SEQ ID NO: 803 - DNA, 327 bp, Mus musculus; identical to SEQ ID NO: 51

SEQ ID NO: 804 - protein, 109 aa, Mus musculus; identical to SEQ ID NO: 52

SEQ ID NO: 805 - DNA, 21 bp, Mus musculus
acttctggtatgggtgtgagc

SEQ ID NO: 806 - protein, 7 aa, Mus musculus
TSGMGVS

SEQ ID NO: 807 - DNA, 48 bp, Mus musculus; identical to SEQ ID NO: 39

SEQ ID NO: 808 - protein, 16 aa, Mus musculus
HIYWDDDKRYNPSLKS

SEQ ID NO: 809 - DNA, 24 bp, Mus musculus
agaagagggtatggttacgactac

SEQ ID NO: 810 - protein, 8 aa, Mus musculus
RRGYGYDY

SEQ ID NO: 811 - DNA, 48 bp, Mus musculus; identical to SEQ ID NO: 27

SEQ ID NO: 812 - protein, 16 aa, Mus musculus
RSSQSIVHSNGNTYLE

SEQ ID NO: 813 - DNA, 21 bp, Mus musculus
aaagtttccaaccgattttct

SEQ ID NO: 814 - protein, 7 aa, Mus musculus
KVSNRFS

SEQ ID NO: 815 - DNA, 27 bp, Mus musculus
tttcaaggttcacatgttccgctcacg

SEQ ID NO: 816 - protein, 9 aa, Mus musculus
FQGSHVPLT

SEQ ID NO: 817 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagggggtaactacctacgatactatgctatggactactggggtcaaggaacctcagtcaccgtctcctca

SEQ ID NO: 818 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGNYLRYYAMDYWGQGTSVTVSS

SEQ ID NO: 819 - DNA, 327 bp, Mus musculus; identical to SEQ ID NO: 227

SEQ ID NO: 820 - protein, 109 aa, Mus musculus; identical to SEQ ID NO: 52

SEQ ID NO: 821 - DNA, 15 bp, Mus musculus
agctttggaatgcac

SEQ ID NO: 822 - protein, 5 aa, Mus musculus
SFGMH

SEQ ID NO: 823 - DNA, 51 bp, Mus musculus; identical to SEQ ID NO: 119

SEQ ID NO: 824 - protein, 17 aa, Mus musculus
YISSGSSTIYYADTVKG

SEQ ID NO: 825 - DNA, 36 bp, Mus musculus
gggggtaactacctacgatactatgctatggactac

SEQ ID NO: 826 - protein, 12 aa, Mus musculus
GGNYLRYYAMDY

SEQ ID NO: 827 - DNA, 48 bp, Mus musculus; identical to SEQ ID NO: 27

SEQ ID NO: 828 - protein, 16 aa, Mus musculus
RSSQSIVHSNGNTYLE

SEQ ID NO: 829 - DNA, 21 bp, Mus musculus
aaagtttccaaccgattttct

SEQ ID NO: 830 - protein, 7 aa, Mus musculus
KVSNRFS

SEQ ID NO: 831 - DNA, 27 bp, Mus musculus
tttcaaggttcacatgttcctctcacg

SEQ ID NO: 832 - protein, 9 aa, Mus musculus
FQGSHVPLT

SEQ ID NO: 833 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagcccctactatgattacgggaggatttgcttactggggccaagggactctggtcactgtctctgca

SEQ ID NO: 834 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAPTMITGGFAYWGQGTLVTVSA

SEQ ID NO: 835 - DNA, 327 bp, Mus musculus; identical to SEQ ID NO: 51

SEQ ID NO: 836 - protein, 109 aa, Mus musculus; identical to SEQ ID NO: 52

SEQ ID NO: 837 - DNA, 15 bp, Mus musculus
agctttggaatgcac

SEQ ID NO: 838 - protein, 5 aa, Mus musculus
SFGMH

SEQ ID NO: 839 - DNA, 51 bp, Mus musculus; identical to SEQ ID NO: 119

SEQ ID NO: 840 - protein, 17 aa, Mus musculus
YISSGSSTIYYADTVKG

SEQ ID NO: 841 - DNA, 33 bp, Mus musculus
gcccctactatgattacgggaggatttgcttac

SEQ ID NO: 842 - protein, 11 aa, Mus musculus
APTMITGGFAY

SEQ ID NO: 843 - DNA, 48 bp, Mus musculus; identical to SEQ ID NO: 27

SEQ ID NO: 844 - protein, 16 aa, Mus musculus
RSSQSIVHSNGNTYLE

SEQ ID NO: 845 - DNA, 21 bp, Mus musculus
aaagtttccaaccgattttct

SEQ ID NO: 846 - protein, 7 aa, Mus musculus
KVSNRFS

SEQ ID NO: 847 - DNA, 27 bp, Mus musculus
tttcaaggttcacatgttccgctcacg

SEQ ID NO: 848 - protein, 9 aa, Mus musculus
FQGSHVPLT

SEQ ID NO: 849 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatattaccactatgctatggactactggggtcaaggaacctcagtcaccgtctcctca

SEQ ID NO: 850 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYHYAMDYWGQGTSVTVSS

SEQ ID NO: 851 - DNA, 327 bp, Mus musculus; identical to SEQ ID NO: 243

SEQ ID NO: 852 - protein, 109 aa, Mus musculus; identical to SEQ ID NO: 244

SEQ ID NO: 853 - DNA, 15 bp, Mus musculus
agctttggaatgcac

SEQ ID NO: 854 - protein, 5 aa, Mus musculus
SFGMH

SEQ ID NO: 855 - DNA, 51 bp, Mus musculus; identical to SEQ ID NO: 119

SEQ ID NO: 856 - protein, 17 aa, Mus musculus
YISSGSSTIYYADTVKG

SEQ ID NO: 857 - DNA, 24 bp, Mus musculus
tattaccactatgctatggactac

SEQ ID NO: 858 - protein, 8 aa, Mus musculus
YYHYAMDY

SEQ ID NO: 859 - DNA, 48 bp, Mus musculus; identical to SEQ ID NO: 27

SEQ ID NO: 860 - protein, 16 aa, Mus musculus
RSSQSIVHSNGNTYLE

SEQ ID NO: 861 - DNA, 21 bp, Mus musculus
aaagtttccaaccgattttct

SEQ ID NO: 862 - protein, 7 aa, Mus musculus
KVSNRFS

SEQ ID NO: 863 - DNA, 27 bp, Mus musculus
tttcaaggttcacatgttcctccgacg

SEQ ID NO: 864 - protein, 9 aa, Mus musculus
FQGSHVPPT

SEQ ID NO: 865 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggggactttgactactggggccaaggcaccactctcacagtctcctca

SEQ ID NO: 866 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGDFDYWGQGTTLTVSS

SEQ ID NO: 867 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgctcacgttcggtgctgggaccaagctggagctgaaa

SEQ ID NO: 868 - protein, 109 aa, Mus musculus; identical to SEQ ID NO: 36

SEQ ID NO: 869 - DNA, 15 bp, Mus musculus
agctttggaatgcac

SEQ ID NO: 870 - protein, 5 aa, Mus musculus
SFGMH

SEQ ID NO: 871 - DNA, 51 bp, Mus musculus; identical to SEQ ID NO: 119

SEQ ID NO: 872 - protein, 17 aa, Mus musculus
YISSGSSTIYYADTVKG

SEQ ID NO: 873 - DNA, 18 bp, Mus musculus
gagggggactttgactac

SEQ ID NO: 874 - protein, 6 aa, Mus musculus
EGDFDY

SEQ ID NO: 875 - DNA, 48 bp, Mus musculus; identical to SEQ ID NO: 43

SEQ ID NO: 876 - protein, 16 aa, Mus musculus
RSSQSLVHSNGNTYLH

SEQ ID NO: 877 - DNA, 21 bp, Mus musculus
aaagtttccaaccgattttct

SEQ ID NO: 878 - protein, 7 aa, Mus musculus
KVSNRFS

SEQ ID NO: 879 - DNA, 27 bp, Mus musculus
tctcaaagtacacatgttccgctcacg

SEQ ID NO: 880 - protein, 9 aa, Mus musculus
SQSTHVPLT

SEQ ID NO: 881 - DNA, 408 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctggcgggtttgcttactggggccaagggactctggtcactgtctctgca

SEQ ID NO: 882 - protein, 136 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAGGFAYWGQGTLVTVSA

SEQ ID NO: 883 - DNA, 327 bp, Mus musculus; identical to SEQ ID NO: 51

SEQ ID NO: 884 - protein, 109 aa, Mus musculus; identical to SEQ ID NO: 52

SEQ ID NO: 885 - DNA, 21 bp, Mus musculus
acttctggtatgggtgtgagc

SEQ ID NO: 886 - protein, 7 aa, Mus musculus
TSGMGVS

SEQ ID NO: 887 - DNA, 48 bp, Mus musculus; identical to SEQ ID NO: 39

SEQ ID NO: 888 - protein, 16 aa, Mus musculus
HIYWDDDKRYNPSLKS

SEQ ID NO: 889 - DNA, 21 bp, Mus musculus
agagctggcgggtttgcttac

SEQ ID NO: 890 - protein, 7 aa, Mus musculus
RAGGFAY

SEQ ID NO: 891 - DNA, 48 bp, Mus musculus; identical to SEQ ID NO: 27

SEQ ID NO: 892 - protein, 16 aa, Mus musculus
RSSQSIVHSNGNTYLE

SEQ ID NO: 893 - DNA, 21 bp, Mus musculus
aaagtttccaaccgattttct

SEQ ID NO: 894 - protein, 7 aa, Mus musculus
KVSNRFS

SEQ ID NO: 895 - DNA, 27 bp, Mus musculus
tttcaaggttcacatgttccgctcacg

SEQ ID NO: 896 - protein, 9 aa, Mus musculus
FQGSHVPLT

SEQ ID NO: 897 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactacggtagtagctatgctatggactactggggtcaaggaacctcagtcaccgtctcctca

SEQ ID NO: 898 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGSSYAMDYWGQGTSVTVSS

SEQ ID NO: 899 - DNA, 327 bp, Mus musculus; identical to SEQ ID NO: 51

SEQ ID NO: 900 - protein, 109 aa, Mus musculus; identical to SEQ ID NO: 52

SEQ ID NO: 901 - DNA, 15 bp, Mus musculus
agctttggaatgcac

SEQ ID NO: 902 - protein, 5 aa, Mus musculus
SFGMH

SEQ ID NO: 903 - DNA, 51 bp, Mus musculus; identical to SEQ ID NO: 119

SEQ ID NO: 904 - protein, 17 aa, Mus musculus
YISSGSSTIYYADTVKG

SEQ ID NO: 905 - DNA, 30 bp, Mus musculus
tactacggtagtagctatgctatggactac

SEQ ID NO: 906 - protein, 10 aa, Mus musculus
YYGSSYAMDY

SEQ ID NO: 907 - DNA, 48 bp, Mus musculus; identical to SEQ ID NO: 27

SEQ ID NO: 908 - protein, 16 aa, Mus musculus
RSSQSIVHSNGNTYLE

SEQ ID NO: 909 - DNA, 21 bp, Mus musculus
aaagtttccaaccgattttct

SEQ ID NO: 910 - protein, 7 aa, Mus musculus
KVSNRFS

SEQ ID NO: 911 - DNA, 27 bp, Mus musculus
tttcaaggttcacatgttccgctcacg

SEQ ID NO: 912 - protein, 9 aa, Mus musculus
FQGSHVPLT

SEQ ID NO: 913 - DNA, 417 bp, Mus musculus
atggctgtcttggggctgctcttctgcctggtgacattcccaagctgtgtcctatcccaggtgcagctgaagcagtcaggacctggcctagtgcagccctcacagagcctgtccatcacctgcacagtctctggtttctcattaactagctatggtgtacactgggttcgccagtctccaggaaagggtctggagtggctgggagtgatatggagtggtggaagcacagactataatgcagctttcatatccagactgagcatcagcaaggacaattccaagagccaagttttctttaaaatgaacagtctgcaagctaatgacacagccatatattactgtgccagaaaagcctactataggtacggctatgctatggactactggggtcaaggaacctcagtcaccgtctcctca

SEQ ID NO: 914 - protein, 139 aa, Mus musculus
MAVLGLLFCLVTFPSCVLSQVQLKQSGPGLVQPSQSLSITCTVSGFSLTSYGVHWVRQSPGKGLEWLGVIWSGGSTDYNAAFISRLSISKDNSKSQVFFKMNSLQANDTAIYYCARKAYYRYGYAMDYWGQGTSVTVSS

SEQ ID NO: 915 - DNA, 327 bp, Mus musculus; identical to SEQ ID NO: 227

SEQ ID NO: 916 - protein, 109 aa, Mus musculus; identical to SEQ ID NO: 52

SEQ ID NO: 917 - DNA, 15 bp, Mus musculus
agctatggtgtacac

SEQ ID NO: 918 - protein, 5 aa, Mus musculus
SYGVH

SEQ ID NO: 919 - DNA, 48 bp, Mus musculus; identical to SEQ ID NO: 7

SEQ ID NO: 920 - protein, 16 aa, Mus musculus
VIWSGGSTDYNAAFIS

SEQ ID NO: 921 - DNA, 36 bp, Mus musculus
aaagcctactataggtacggctatgctatggactac

SEQ ID NO: 922 - protein, 12 aa, Mus musculus
KAYYRYGYAMDY

SEQ ID NO: 923 - DNA, 48 bp, Mus musculus; identical to SEQ ID NO: 27

SEQ ID NO: 924 - protein, 16 aa, Mus musculus
RSSQSIVHSNGNTYLE

SEQ ID NO: 925 - DNA, 21 bp, Mus musculus
aaagtttccaaccgattttct

SEQ ID NO: 926 - protein, 7 aa, Mus musculus
KVSNRFS

SEQ ID NO: 927 - DNA, 27 bp, Mus musculus
tttcaaggttcacatgttcctctcacg

SEQ ID NO: 928 - protein, 9 aa, Mus musculus
FQGSHVPLT

SEQ ID NO: 929 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggaggtaactaccttatggactactggggtcaaggaacctcagtcaccgtctcctca

SEQ ID NO: 930 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGNYLMDYWGQGTSVTVSS

SEQ ID NO: 931 - DNA, 327 bp, Mus musculus; identical to SEQ ID NO: 51

SEQ ID NO: 932 - protein, 109 aa, Mus musculus; identical to SEQ ID NO: 52

SEQ ID NO: 933 - DNA, 15 bp, Mus musculus
agctttggaatgcac

SEQ ID NO: 934 - protein, 5 aa, Mus musculus
SFGMH

SEQ ID NO: 935 - DNA, 51 bp, Mus musculus; identical to SEQ ID NO: 119

SEQ ID NO: 936 - protein, 17 aa, Mus musculus
YISSGSSTIYYADTVKG

SEQ ID NO: 937 - DNA, 27 bp, Mus musculus
tcgggaggtaactaccttatggactac

SEQ ID NO: 938 - protein, 9 aa, Mus musculus
SGGNYLMDY

SEQ ID NO: 939 - DNA, 48 bp, Mus musculus; identical to SEQ ID NO: 27

SEQ ID NO: 940 - protein, 16 aa, Mus musculus
RSSQSIVHSNGNTYLE

SEQ ID NO: 941 - DNA, 21 bp, Mus musculus
aaagtttccaaccgattttct

SEQ ID NO: 942 - protein, 7 aa, Mus musculus
KVSNRFS

SEQ ID NO: 943 - DNA, 27 bp, Mus musculus
tttcaaggttcacatgttccgctcacg

SEQ ID NO: 944 - protein, 9 aa, Mus musculus
FQGSHVPLT

SEQ ID NO: 945 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatctgggactacggctacgattgactactggggccaaggcaccactctcacagtctcctca

SEQ ID NO: 946 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTTATIDYWGQGTTLTVSS

SEQ ID NO: 947 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggctcggggacaaagttggaaataaaa

SEQ ID NO: 948 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGSGTKLEIK

SEQ ID NO: 949 - DNA, 15 bp, Mus musculus
agctttggaatgcac

SEQ ID NO: 950 - protein, 5 aa, Mus musculus
SFGMH

SEQ ID NO: 951 - DNA, 51 bp, Mus musculus; identical to SEQ ID NO: 119

SEQ ID NO: 952 - protein, 17 aa, Mus musculus
YISSGSSTIYYADTVKG

SEQ ID NO: 953 - DNA, 27 bp, Mus musculus
tctgggactacggctacgattgactac

SEQ ID NO: 954 - protein, 9 aa, Mus musculus
SGTTATIDY

SEQ ID NO: 955 - DNA, 48 bp, Mus musculus; identical to SEQ ID NO: 27

SEQ ID NO: 956 - protein, 16 aa, Mus musculus
RSSQSIVHSNGNTYLE

SEQ ID NO: 957 - DNA, 21 bp, Mus musculus
aaagtttccaaccgattttct

SEQ ID NO: 958 - protein, 7 aa, Mus musculus
KVSNRFS

SEQ ID NO: 959 - DNA, 27 bp, Mus musculus
tttcaaggttcacatgttcctcccacg

SEQ ID NO: 960 - protein, 9 aa, Mus musculus
FQGSHVPPT

SEQ ID NO: 961 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaaggcattggaactatgctatggactactggggtcaaggaacctcagtcaccgtctcctca

SEQ ID NO: 962 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRHWNYAMDYWGQGTSVTVSS

SEQ ID NO: 963 - DNA, 327 bp, Mus musculus; identical to SEQ ID NO: 51

SEQ ID NO: 964 - protein, 109 aa, Mus musculus; identical to SEQ ID NO: 52

SEQ ID NO: 965 - DNA, 15 bp, Mus musculus
agctttggaatgcac

SEQ ID NO: 966 - protein, 5 aa, Mus musculus
SFGMH

SEQ ID NO: 967 - DNA, 51 bp, Mus musculus; identical to SEQ ID NO: 119

SEQ ID NO: 968 - protein, 17 aa, Mus musculus
YISSGSSTIYYADTVKG

SEQ ID NO: 969 - DNA, 27 bp, Mus musculus
aggcattggaactatgctatggactac

SEQ ID NO: 970 - protein, 9 aa, Mus musculus
RHWNYAMDY

SEQ ID NO: 971 - DNA, 48 bp, Mus musculus; identical to SEQ ID NO: 27

SEQ ID NO: 972 - protein, 16 aa, Mus musculus
RSSQSIVHSNGNTYLE

SEQ ID NO: 973 - DNA, 21 bp, Mus musculus
aaagtttccaaccgattttct

SEQ ID NO: 974 - protein, 7 aa, Mus musculus
KVSNRFS

SEQ ID NO: 975 - DNA, 27 bp, Mus musculus
tttcaaggttcacatgttccgctcacg

SEQ ID NO: 976 - protein, 9 aa, Mus musculus
FQGSHVPLT

SEQ ID NO: 977 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgagactacggctacgtttgcttactggggccaagggactctggtcactgtctctgca

SEQ ID NO: 978 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDETTATFAYWGQGTLVTVSA

SEQ ID NO: 979 - DNA, 327 bp, Mus musculus; identical to SEQ ID NO: 339

SEQ ID NO: 980 - protein, 109 aa, Mus musculus; identical to SEQ ID NO: 340

SEQ ID NO: 981 - DNA, 15 bp, Mus musculus
agctttggaatgcac

SEQ ID NO: 982 - protein, 5 aa, Mus musculus
SFGMH

SEQ ID NO: 983 - DNA, 51 bp, Mus musculus; identical to SEQ ID NO: 119

SEQ ID NO: 984 - protein, 17 aa, Mus musculus
YISSGSSTIYYADTVKG

SEQ ID NO: 985 - DNA, 27 bp, Mus musculus
gatgagactacggctacgtttgcttac

SEQ ID NO: 986 - protein, 9 aa, Mus musculus
DETTATFAY

SEQ ID NO: 987 - DNA, 48 bp, Mus musculus; identical to SEQ ID NO: 43

SEQ ID NO: 988 - protein, 16 aa, Mus musculus
RSSQSLVHSNGNTYLH

SEQ ID NO: 989 - DNA, 21 bp, Mus musculus
aaagtttccaaccgattttct

SEQ ID NO: 990 - protein, 7 aa, Mus musculus
KVSNRFS

SEQ ID NO: 991 - DNA, 27 bp, Mus musculus
tctcaaagtacacatgttcctccgacg

SEQ ID NO: 992 - protein, 9 aa, Mus musculus
SQSTHVPPT

SEQ ID NO: 993 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgtagacacagtgaagggccgattcaccatctccagagacaatcccaagaacaccctgttcctgcaaatgaccagtctaaggtctgaggacacggccatgtattactgtgcaacagtatggtccggtgctatggactactggggtcaaggaacctcagtcaccgtctcctca

SEQ ID NO: 994 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYVDTVKGRFTISRDNPKNTLFLQMTSLRSEDTAMYYCATVWSGAMDYWGQGTSVTVSS

SEQ ID NO: 995 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctccgacgttcggtggaggcaccaaggtggaaatcaaa

SEQ ID NO: 996 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKVEIK

SEQ ID NO: 997 - DNA, 15 bp, Mus musculus
agctttggaatgcac

SEQ ID NO: 998 - protein, 5 aa, Mus musculus
SFGMH

SEQ ID NO: 999 - DNA, 51 bp, Mus musculus
tacattagtagtggcagtagtaccatctactatgtagacacagtgaagggc

SEQ ID NO: 1000 - protein, 17 aa, Mus musculus
YISSGSSTIYYVDTVKG

SEQ ID NO: 1001 - DNA, 24 bp, Mus musculus
gtatggtccggtgctatggactac

SEQ ID NO: 1002 - protein, 8 aa, Mus musculus
VWSGAMDY

SEQ ID NO: 1003 - DNA, 48 bp, Mus musculus; identical to SEQ ID NO: 27

SEQ ID NO: 1004 - protein, 16 aa, Mus musculus
RSSQSIVHSNGNTYLE

SEQ ID NO: 1005 - DNA, 21 bp, Mus musculus
aaagtttccaaccgattttct

SEQ ID NO: 1006 - protein, 7 aa, Mus musculus
KVSNRFS

SEQ ID NO: 1007 - DNA, 27 bp, Mus musculus
tttcaaggttcacatgttcctccgacg

SEQ ID NO: 1008 - protein, 9 aa, Mus musculus
FQGSHVPPT

SEQ ID NO: 1009 - DNA, 426 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagccttattactacggtaccctaatgctatggactactggggtcaaggaacctcagtcaccgtctcctca

SEQ ID NO: 1010 - protein, 142 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRALLLRYPNAMDYWGQGTSVTVSS

SEQ ID NO: 1011 - DNA, 327 bp, Mus musculus; identical to SEQ ID NO: 51

SEQ ID NO: 1012 - protein, 109 aa, Mus musculus; identical to SEQ ID NO: 52

SEQ ID NO: 1013 - DNA, 21 bp, Mus musculus
acttctggtatgggtgtgagc

SEQ ID NO: 1014 - protein, 7 aa, Mus musculus
TSGMGVS

SEQ ID NO: 1015 - DNA, 48 bp, Mus musculus; identical to SEQ ID NO: 39

SEQ ID NO: 1016 - protein, 16 aa, Mus musculus
HIYWDDDKRYNPSLKS

SEQ ID NO: 1017 - DNA, 39 bp, Mus musculus
agagccttattactacggtaccctaatgctatggactac

SEQ ID NO: 1018 - protein, 13 aa, Mus musculus
RALLLRYPNAMDY

SEQ ID NO: 1019 - DNA, 48 bp, Mus musculus; identical to SEQ ID NO: 27

SEQ ID NO: 1020 - protein, 16 aa, Mus musculus
RSSQSIVHSNGNTYLE

SEQ ID NO: 1021 - DNA, 21 bp, Mus musculus
aaagtttccaaccgattttct

SEQ ID NO: 1022 - protein, 7 aa, Mus musculus
KVSNRFS

SEQ ID NO: 1023 - DNA, 27 bp, Mus musculus
tttcaaggttcacatgttccgctcacg

SEQ ID NO: 1024 - protein, 9 aa, Mus musculus
FQGSHVPLT

SEQ ID NO: 1025 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggttactacctctactatgctatggactactggggtcaaggaacctcagtcaccgtctcctca

SEQ ID NO: 1026 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYLYYAMDYWGQGTSVTVSS

SEQ ID NO: 1027 - DNA, 327 bp, Mus musculus; identical to SEQ ID NO: 51

SEQ ID NO: 1028 - protein, 109 aa, Mus musculus; identical to SEQ ID NO: 52

SEQ ID NO: 1029 - DNA, 15 bp, Mus musculus
agctttggaatgcac

SEQ ID NO: 1030 - protein, 5 aa, Mus musculus
SFGMH

SEQ ID NO: 1031 - DNA, 51 bp, Mus musculus; identical to SEQ ID NO: 119

SEQ ID NO: 1032 - protein, 17 aa, Mus musculus
YISSGSSTIYYADTVKG

SEQ ID NO: 1033 - DNA, 33 bp, Mus musculus
tatggttactacctctactatgctatggactac

SEQ ID NO: 1034 - protein, 11 aa, Mus musculus
YGYYLYYAMDY

SEQ ID NO: 1035 - DNA, 48 bp, Mus musculus; identical to SEQ ID NO: 27

SEQ ID NO: 1036 - protein, 16 aa, Mus musculus
RSSQSIVHSNGNTYLE

SEQ ID NO: 1037 - DNA, 21 bp, Mus musculus
aaagtttccaaccgattttct

SEQ ID NO: 1038 - protein, 7 aa, Mus musculus
KVSNRFS

SEQ ID NO: 1039 - DNA, 27 bp, Mus musculus
tttcaaggttcacatgttccgctcacg

SEQ ID NO: 1040 - protein, 9 aa, Mus musculus
FQGSHVPLT

SEQ ID NO: 1041 - DNA, 414 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctccattactacggctggggtacttcgatgtctggggcgcagggaccacggtcaccgtctcctca

SEQ ID NO: 1042 - protein, 138 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCAPLLRLGYFDVWGAGTTVTVSS

SEQ ID NO: 1043 - DNA, 327 bp, Mus musculus; identical to SEQ ID NO: 867

SEQ ID NO: 1044 - protein, 109 aa, Mus musculus; identical to SEQ ID NO: 36

SEQ ID NO: 1045 - DNA, 21 bp, Mus musculus
acttctggtatgggtgtgagc

SEQ ID NO: 1046 - protein, 7 aa, Mus musculus
TSGMGVS

SEQ ID NO: 1047 - DNA, 48 bp, Mus musculus; identical to SEQ ID NO: 39

SEQ ID NO: 1048 - protein, 16 aa, Mus musculus
HIYWDDDKRYNPSLKS

SEQ ID NO: 1049 - DNA, 27 bp, Mus musculus
ttactacggctggggtacttcgatgtc

SEQ ID NO: 1050 - protein, 9 aa, Mus musculus
LLRLGYFDV

SEQ ID NO: 1051 - DNA, 48 bp, Mus musculus; identical to SEQ ID NO: 43

SEQ ID NO: 1052 - protein, 16 aa, Mus musculus
RSSQSLVHSNGNTYLH

SEQ ID NO: 1053 - DNA, 21 bp, Mus musculus
aaagtttccaaccgattttct

SEQ ID NO: 1054 - protein, 7 aa, Mus musculus
KVSNRFS

SEQ ID NO: 1055 - DNA, 27 bp, Mus musculus
tctcaaagtacacatgttccgctcacg

SEQ ID NO: 1056 - protein, 9 aa, Mus musculus
SQSTHVPLT

SEQ ID NO: 1057 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattgggaactgggacgggggctatggactactggggtcaaggaacctcagtcaccgtctcctca

SEQ ID NO: 1058 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGTGTGAMDYWGQGTSVTVSS

SEQ ID NO: 1059 - DNA, 327 bp, Mus musculus; identical to SEQ ID NO: 595

SEQ ID NO: 1060 - protein, 109 aa, Mus musculus; identical to SEQ ID NO: 596

SEQ ID NO: 1061 - DNA, 15 bp, Mus musculus
agctttggaatgcac

SEQ ID NO: 1062 - protein, 5 aa, Mus musculus
SFGMH

SEQ ID NO: 1063 - DNA, 51 bp, Mus musculus; identical to SEQ ID NO: 119

SEQ ID NO: 1064 - protein, 17 aa, Mus musculus
YISSGSSTIYYADTVKG

SEQ ID NO: 1065 - DNA, 30 bp, Mus musculus
ttgggaactgggacgggggctatggactac

SEQ ID NO: 1066 - protein, 10 aa, Mus musculus
LGTGTGAMDY

SEQ ID NO: 1067 - DNA, 48 bp, Mus musculus; identical to SEQ ID NO: 43

SEQ ID NO: 1068 - protein, 16 aa, Mus musculus
RSSQSLVHSNGNTYLH

SEQ ID NO: 1069 - DNA, 21 bp, Mus musculus
aaagtttccaaccgattttct

SEQ ID NO: 1070 - protein, 7 aa, Mus musculus
KVSNRFS

SEQ ID NO: 1071 - DNA, 27 bp, Mus musculus
tctcaaagtacacatgttccgtggacg

SEQ ID NO: 1072 - protein, 9 aa, Mus musculus
SQSTHVPWT

SEQ ID NO: 1073 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagacgggggatatacggctactatgctatggactactggggtcaaggaacctcagtcaccgtctcctca

SEQ ID NO: 1074 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGIYGYYAMDYWGQGTSVTVSS

SEQ ID NO: 1075 - DNA, 327 bp, Mus musculus; identical to SEQ ID NO: 51

SEQ ID NO: 1076 - protein, 109 aa, Mus musculus; identical to SEQ ID NO: 52

SEQ ID NO: 1077 - DNA, 15 bp, Mus musculus
agctttggaatgcac

SEQ ID NO: 1078 - protein, 5 aa, Mus musculus
SFGMH

SEQ ID NO: 1079 - DNA, 51 bp, Mus musculus; identical to SEQ ID NO: 119

SEQ ID NO: 1080 - protein, 17 aa, Mus musculus
YISSGSSTIYYADTVKG

SEQ ID NO: 1081 - DNA, 33 bp, Mus musculus
cgggggatatacggctactatgctatggactac

SEQ ID NO: 1082 - protein, 11 aa, Mus musculus
RGIYGYYAMDY

SEQ ID NO: 1083 - DNA, 48 bp, Mus musculus; identical to SEQ ID NO: 27

SEQ ID NO: 1084 - protein, 16 aa, Mus musculus
RSSQSIVHSNGNTYLE

SEQ ID NO: 1085 - DNA, 21 bp, Mus musculus
aaagtttccaaccgattttct

SEQ ID NO: 1086 - protein, 7 aa, Mus musculus
KVSNRFS

SEQ ID NO: 1087 - DNA, 27 bp, Mus musculus
tttcaaggttcacatgttccgctcacg

SEQ ID NO: 1088 - protein, 9 aa, Mus musculus
FQGSHVPLT

SEQ ID NO: 1089 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggctataggtacagttactatgctatggactactggggtcaaggaacctcagtcaccgtctcctca

SEQ ID NO: 1090 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGYRYSYYAMDYWGQGTSVTVSS

SEQ ID NO: 1091 - DNA, 327 bp, Mus musculus; identical to SEQ ID NO: 51

SEQ ID NO: 1092 - protein, 109 aa, Mus musculus; identical to SEQ ID NO: 52

SEQ ID NO: 1093 - DNA, 15 bp, Mus musculus
agctttggaatgcac

SEQ ID NO: 1094 - protein, 5 aa, Mus musculus
SFGMH

SEQ ID NO: 1095 - DNA, 51 bp, Mus musculus; identical to SEQ ID NO: 119

SEQ ID NO: 1096 - protein, 17 aa, Mus musculus
YISSGSSTIYYADTVKG

SEQ ID NO: 1097 - DNA, 36 bp, Mus musculus
tcgggctataggtacagttactatgctatggactac

SEQ ID NO: 1098 - protein, 12 aa, Mus musculus
SGYRYSYYAMDY

SEQ ID NO: 1099 - DNA, 48 bp, Mus musculus; identical to SEQ ID NO: 27

SEQ ID NO: 1100 - protein, 16 aa, Mus musculus
RSSQSIVHSNGNTYLE

SEQ ID NO: 1101 - DNA, 21 bp, Mus musculus
aaagtttccaaccgattttct

SEQ ID NO: 1102 - protein, 7 aa, Mus musculus
KVSNRFS

SEQ ID NO: 1103 - DNA, 27 bp, Mus musculus
tttcaaggttcacatgttccgctcacg

SEQ ID NO: 1104 - protein, 9 aa, Mus musculus
FQGSHVPLT

SEQ ID NO: 1105 - DNA, 297 bp, Mus musculus
atgtcctgcaaggcttctggctacacctttactagctactggatgcactgggtaaaacagaggcctggacagggtctggaatggattggatacattaatcctagcactggttatactgagtacaatcagaagttcaaggacaaggccacattgactgcagacaaatcctccagcacagcctacatgcaactgagcagcctgacatctgaggactctgcagtctattactgtgcaagatgggacggtaggggctactttgactactggggccaaggcaccactctcacagtctcctca

SEQ ID NO: 1106 - protein, 99 aa, Mus musculus
MSCKASGYTFTSYWMHWVKQRPGQGLEWIGYINPSTGYTEYNQKFKDKATLTADKSSSTAYMQLSSLTSEDSAVYYCARWDGRGYFDYWGQGTTLTVSS

SEQ ID NO: 1107 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggtgctgggaccaagctggagctgaaa

SEQ ID NO: 1108 - protein, 109 aa, Mus musculus; identical to SEQ ID NO: 36

SEQ ID NO: 1109 - DNA, 15 bp, Mus musculus
agctactggatgcac

SEQ ID NO: 1110 - protein, 5 aa, Mus musculus
SYWMH

SEQ ID NO: 1111 - DNA, 51 bp, Mus musculus
tacattaatcctagcactggttatactgagtacaatcagaagttcaaggac

SEQ ID NO: 1112 - protein, 17 aa, Mus musculus
YINPSTGYTEYNQKFKD

SEQ ID NO: 1113 - DNA, 27 bp, Mus musculus
tgggacggtaggggctactttgactac

SEQ ID NO: 1114 - protein, 9 aa, Mus musculus
WDGRGYFDY

SEQ ID NO: 1115 - DNA, 48 bp, Mus musculus; identical to SEQ ID NO: 43

SEQ ID NO: 1116 - protein, 16 aa, Mus musculus
RSSQSLVHSNGNTYLH

SEQ ID NO: 1117 - DNA, 21 bp, Mus musculus
aaagtttccaaccgattttct

SEQ ID NO: 1118 - protein, 7 aa, Mus musculus
KVSNRFS

SEQ ID NO: 1119 - DNA, 27 bp, Mus musculus
tctcaaagtacacatgttcctctcacg

SEQ ID NO: 1120 - protein, 9 aa, Mus musculus
SQSTHVPLT

SEQ ID NO: 1121 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaccctatattactatgctatggactactggggtcaaggaacctcagtcaccgtctcctca

SEQ ID NO: 1122 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGTLYYYAMDYWGQGTSVTVSS

SEQ ID NO: 1123 - DNA, 327 bp, Mus musculus; identical to SEQ ID NO: 243

SEQ ID NO: 1124 - protein, 109 aa, Mus musculus; identical to SEQ ID NO: 244

SEQ ID NO: 1125 - DNA, 15 bp, Mus musculus
agctttggaatgcac

SEQ ID NO: 1126 - protein, 5 aa, Mus musculus
SFGMH

SEQ ID NO: 1127 - DNA, 51 bp, Mus musculus; identical to SEQ ID NO: 119

SEQ ID NO: 1128 - protein, 17 aa, Mus musculus
YISSGSSTIYYADTVKG

SEQ ID NO: 1129 - DNA, 33 bp, Mus musculus
tatggtaccctatattactatgctatggactac

SEQ ID NO: 1130 - protein, 11 aa, Mus musculus
YGTLYYYAMDY

SEQ ID NO: 1131 - DNA, 48 bp, Mus musculus; identical to SEQ ID NO: 27

SEQ ID NO: 1132 - protein, 16 aa, Mus musculus
RSSQSIVHSNGNTYLE

SEQ ID NO: 1133 - DNA, 21 bp, Mus musculus
aaagtttccaaccgattttct

SEQ ID NO: 1134 - protein, 7 aa, Mus musculus
KVSNRFS

SEQ ID NO: 1135 - DNA, 27 bp, Mus musculus
tttcaaggttcacatgttcctccgacg

SEQ ID NO: 1136 - protein, 9 aa, Mus musculus
FQGSHVPPT

SEQ ID NO: 1137 - DNA, 414 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgagggatgattacgacggcgtttgcttactggggccaagggactctggtcactgtctctgca

SEQ ID NO: 1138 - protein, 138 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGMITTAFAYWGQGTLVTVSA

SEQ ID NO: 1139 - DNA, 327 bp, Mus musculus; identical to SEQ ID NO: 51

SEQ ID NO: 1140 - protein, 109 aa, Mus musculus; identical to SEQ ID NO: 52

SEQ ID NO: 1141 - DNA, 21 bp, Mus musculus
acttctggtatgggtgtgagc

SEQ ID NO: 1142 - protein, 7 aa, Mus musculus
TSGMGVS

SEQ ID NO: 1143 - DNA, 48 bp, Mus musculus; identical to SEQ ID NO: 39

SEQ ID NO: 1144 - protein, 16 aa, Mus musculus
HIYWDDDKRYNPSLKS

SEQ ID NO: 1145 - DNA, 27 bp, Mus musculus
gggatgattacgacggcgtttgcttac

SEQ ID NO: 1146 - protein, 9 aa, Mus musculus
GMITTAFAY

SEQ ID NO: 1147 - DNA, 48 bp, Mus musculus; identical to SEQ ID NO: 27

SEQ ID NO: 1148 - protein, 16 aa, Mus musculus
RSSQSIVHSNGNTYLE

SEQ ID NO: 1149 - DNA, 21 bp, Mus musculus
aaagtttccaaccgattttct

SEQ ID NO: 1150 - protein, 7 aa, Mus musculus
KVSNRFS

SEQ ID NO: 1151 - DNA, 27 bp, Mus musculus
tttcaaggttcacatgttccgctcacg

SEQ ID NO: 1152 - protein, 9 aa, Mus musculus
FQGSHVPLT

SEQ ID NO: 1153 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagacgctggggggagggtgctatggactactggggtcaaggaacctcagtcaccgtctcctca

SEQ ID NO: 1154 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRWGEGAMDYWGQGTSVTVSS

SEQ ID NO: 1155 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacacgttcctccgacgttcggtggaggcaccaagctggaaatcaaa

SEQ ID NO: 1156 - protein, 109 aa, Mus musculus; identical to SEQ ID NO: 244

SEQ ID NO: 1157 - DNA, 15 bp, Mus musculus
agctttggaatgcac

SEQ ID NO: 1158 - protein, 5 aa, Mus musculus
SFGMH

SEQ ID NO: 1159 - DNA, 51 bp, Mus musculus; identical to SEQ ID NO: 119

SEQ ID NO: 1160 - protein, 17 aa, Mus musculus
YISSGSSTIYYADTVKG

SEQ ID NO: 1161 - DNA, 27 bp, Mus musculus
cgctggggggagggtgctatggactac

SEQ ID NO: 1162 - protein, 9 aa, Mus musculus
RWGEGAMDY

SEQ ID NO: 1163 - DNA, 48 bp, Mus musculus; identical to SEQ ID NO: 27

SEQ ID NO: 1164 - protein, 16 aa, Mus musculus
RSSQSIVHSNGNTYLE

SEQ ID NO: 1165 - DNA, 21 bp, Mus musculus
aaagtttccaaccgattttct

SEQ ID NO: 1166 - protein, 7 aa, Mus musculus
KVSNRFS

SEQ ID NO: 1167 - DNA, 27 bp, Mus musculus
tttcaaggttcacacgttcctccgacg

SEQ ID NO: 1168 - protein, 9 aa, Mus musculus
FQGSHVPPT

SEQ ID NO: 1169 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgaaccttttagactactggggccaaggcaccactctcacagtctcctca

SEQ ID NO: 1170 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNLLDYWGQGTTLTVSS

SEQ ID NO: 1171 - DNA, 327 bp, Mus musculus
atgacccaaactccactctccctgcctgtcagtcttggagatcaagcctccatctcttgcaggtctagtcagagccttgaaaacagtaatggaaacacctatttgaactggtacctccagaaaccaggccagtctccacagctcctgatctacagggtttccaaccgattttctggggtcctagacaggttcagtggtagtggatcagggacagatttcacactgaaaatcagcagagtggaggctgaggatttgggagtttatttctgcctccaagttacacatgtccctcccacgttcggaggggggaccaagctggaaataaaa

SEQ ID NO: 1172 - protein, 109 aa, Mus musculus; identical to SEQ ID NO: 484

SEQ ID NO: 1173 - DNA, 15 bp, Mus musculus
agctttggaatgcac

SEQ ID NO: 1174 - protein, 5 aa, Mus musculus
SFGMH

SEQ ID NO: 1175 - DNA, 51 bp, Mus musculus; identical to SEQ ID NO: 119

SEQ ID NO: 1176 - protein, 17 aa, Mus musculus
YISSGSSTIYYADTVKG

SEQ ID NO: 1177 - DNA, 18 bp, Mus musculus
tcgaaccttttagactac

SEQ ID NO: 1178 - protein, 6 aa, Mus musculus
SNLLDY

SEQ ID NO: 1179 - DNA, 48 bp, Mus musculus; identical to SEQ ID NO: 491

SEQ ID NO: 1180 - protein, 16 aa, Mus musculus
RSSQSLENSNGNTYLN

SEQ ID NO: 1181 - DNA, 21 bp, Mus musculus
agggtttccaaccgattttct

SEQ ID NO: 1182 - protein, 7 aa, Mus musculus
RVSNRFS

SEQ ID NO: 1183 - DNA, 27 bp, Mus musculus
ctccaagttacacatgtccctcccacg

SEQ ID NO: 1184 - protein, 9 aa, Mus musculus
LQVTHVPPT

SEQ ID NO: 1185 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtaggtttggaatgtactgggttcgtcaggctccagagaaggggctggagtgggtcgcatacattagtagtggcagtagtaccatctactatgcagacatagtgaagggccgattcaccatctccagagacaatcccaagaacaccctgttcctgcaaatgaccagtctaaggtctgaggacacggccatgtattactgtgcaagaagaggttactacgaagctatggactactggggtcaaggaacctcagtcaccgtctcctca

SEQ ID NO: 1186 - protein, 137 aa, Mus musculus
MDSRLNLVFLVLILKGVQCDVQLVESGGGLVQPGGSRKLSCAASGFTFSRFGMYWVRQAPEKGLEWVAYISSGSSTIYYADIVKGRFTISRDNPKNTLFLQMTSLRSEDTAMYYCARRGYYEAMDYWGQGTSVTVSS

SEQ ID NO: 1187 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgatgatctgggagtttattactgctttcaaggttcacatgttcctccgacgttcggtggaggcaccaagctggaaatcaaa

SEQ ID NO: 1188 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEADDLGVYYCFQGSHVPPTFGGGTKLEIK

SEQ ID NO: 1189 - DNA, 15 bp, Mus musculus
aggtttggaatgtac

SEQ ID NO: 1190 - protein, 5 aa, Mus musculus
RFGMY

SEQ ID NO: 1191 - DNA, 51 bp, Mus musculus
tacattagtagtggcagtagtaccatctactatgcagacatagtgaagggc

SEQ ID NO: 1192 - protein, 17 aa, Mus musculus
YISSGSSTIYYADIVKG

SEQ ID NO: 1193 - DNA, 27 bp, Mus musculus
agaggttactacgaagctatggactac

SEQ ID NO: 1194 - protein, 9 aa, Mus musculus
RGYYEAMDY

SEQ ID NO: 1195 - DNA, 48 bp, Mus musculus; identical to SEQ ID NO: 27

SEQ ID NO: 1196 - protein, 16 aa, Mus musculus
RSSQSIVHSNGNTYLE

SEQ ID NO: 1197 - DNA, 21 bp, Mus musculus
aaagtttccaaccgattttct

SEQ ID NO: 1198 - protein, 7 aa, Mus musculus
KVSNRFS

SEQ ID NO: 1199 - DNA, 27 bp, Mus musculus
tttcaaggttcacatgttcctccgacg

SEQ ID NO: 1200 - protein, 9 aa, Mus musculus
FQGSHVPPT

SEQ ID NO: 1201 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatttattaccacgaggggtgctatggactactggggtcaaggaacctcagtcaccgtctcctca

SEQ ID NO: 1202 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARFITTRGAMDYWGQGTSVTVSS

SEQ ID NO: 1203 - DNA, 327 bp, Mus musculus; identical to SEQ ID NO: 195

SEQ ID NO: 1204 - protein, 109 aa, Mus musculus; identical to SEQ ID NO: 52

SEQ ID NO: 1205 - DNA, 15 bp, Mus musculus
agctttggaatgcac

SEQ ID NO: 1206 - protein, 5 aa, Mus musculus
SFGMH

SEQ ID NO: 1207 - DNA, 51 bp, Mus musculus; identical to SEQ ID NO: 119

SEQ ID NO: 1208 - protein, 17 aa, Mus musculus
YISSGSSTIYYADTVKG

SEQ ID NO: 1209 - DNA, 30 bp, Mus musculus
tttattaccacgaggggtgctatggactac

SEQ ID NO: 1210 - protein, 10 aa, Mus musculus
FITTRGAMDY

SEQ ID NO: 1211 - DNA, 48 bp, Mus musculus; identical to SEQ ID NO: 27

SEQ ID NO: 1212 - protein, 16 aa, Mus musculus
RSSQSIVHSNGNTYLE

SEQ ID NO: 1213 - DNA, 21 bp, Mus musculus
aaagtttccaaccgattttct

SEQ ID NO: 1214 - protein, 7 aa, Mus musculus
KVSNRFS

SEQ ID NO: 1215 - DNA, 27 bp, Mus musculus
tttcaaggttcacatgttccgctcacg

SEQ ID NO: 1216 - protein, 9 aa, Mus musculus
FQGSHVPLT

SEQ ID NO: 1217 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccttctactatgcagacacagtgaagggccgattcaccatctccagagacaatcccaagaacaccctgttcctgcaaatgaccagtctaaggtctgaggacacggccatgtattactgtgcaagagacgggtatggtcgagggggctatgctatggactactggggtcaaggaacctcagtcaccgtctcctca

SEQ ID NO: 1218 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTFYYADTVKGRFTISRDNPKNTLFLQMTSLRSEDTAMYYCARDGYGRGGYAMDYWGQGTSVTVSS

SEQ ID NO: 1219 - DNA, 327 bp, Mus musculus
atgacccaaactccattttccctgcctgtcagtcttggagatcaagcctccatttcttgcagatctagtcagagcattgtacatagtaatggaaacacctatttagaatggtacctgcagaaaccaggccagtctccaaagcccctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggtgctgggaccaagctggagctgaaa

SEQ ID NO: 1220 - protein, 109 aa, Mus musculus
MTQTPFSLPVSLGDQASISCRSSQSIVHSNGNTYLEWYLQKPGQSPKPLIYKVSNRFSGVPDRFSGSGSGTDFTLKISRVEAEDLGVYYCFQGSHVPLTFGAGTKLELK

SEQ ID NO: 1221 - DNA, 15 bp, Mus musculus
agctttggaatgcac

SEQ ID NO: 1222 - protein, 5 aa, Mus musculus
SFGMH

SEQ ID NO: 1223 - DNA, 51 bp, Mus musculus
tacattagtagtggcagtagtaccttctactatgcagacacagtgaagggc

SEQ ID NO: 1224 - protein, 17 aa, Mus musculus
YISSGSSTFYYADTVKG

SEQ ID NO: 1225 - DNA, 36 bp, Mus musculus
gacgggtatggtcgagggggctatgctatggactac

SEQ ID NO: 1226 - protein, 12 aa, Mus musculus
DGYGRGGYAMDY

SEQ ID NO: 1227 - DNA, 48 bp, Mus musculus; identical to SEQ ID NO: 27

SEQ ID NO: 1228 - protein, 16 aa, Mus musculus
RSSQSIVHSNGNTYLE

SEQ ID NO: 1229 - DNA, 21 bp, Mus musculus
aaagtttccaaccgattttct

SEQ ID NO: 1230 - protein, 7 aa, Mus musculus
KVSNRFS

SEQ ID NO: 1231 - DNA, 27 bp, Mus musculus
tttcaaggttcacatgttcctctcacg

SEQ ID NO: 1232 - protein, 9 aa, Mus musculus
FQGSHVPLT

SEQ ID NO: 1233 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagaggttactacgaagctatggactactggggtcaaggaacctcagtcaccgtctcctca

SEQ ID NO: 1234 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGYYEAMDYWGQGTSVTVSS

SEQ ID NO: 1235 - DNA, 327 bp, Mus musculus; identical to SEQ ID NO: 243

SEQ ID NO: 1236 - protein, 109 aa, Mus musculus; identical to SEQ ID NO: 244

SEQ ID NO: 1237 - DNA, 15 bp, Mus musculus
agctttggaatgcac

SEQ ID NO: 1238 - protein, 5 aa, Mus musculus
SFGMH

SEQ ID NO: 1239 - DNA, 51 bp, Mus musculus; identical to SEQ ID NO: 119

SEQ ID NO: 1240 - protein, 17 aa, Mus musculus
YISSGSSTIYYADTVKG

SEQ ID NO: 1241 - DNA, 27 bp, Mus musculus
agaggttactacgaagctatggactac

SEQ ID NO: 1242 - protein, 9 aa, Mus musculus
RGYYEAMDY

SEQ ID NO: 1243 - DNA, 48 bp, Mus musculus; identical to SEQ ID NO: 27

SEQ ID NO: 1244 - protein, 16 aa, Mus musculus
RSSQSIVHSNGNTYLE

SEQ ID NO: 1245 - DNA, 21 bp, Mus musculus
aaagtttccaaccgattttct

SEQ ID NO: 1246 - protein, 7 aa, Mus musculus
KVSNRFS

SEQ ID NO: 1247 - DNA, 27 bp, Mus musculus
tttcaaggttcacatgttcctccgacg

SEQ ID NO: 1248 - protein, 9 aa, Mus musculus
FQGSHVPPT

SEQ ID NO: 1249 - DNA, 411 bp, Mus musculus
atgggcaggcttacttcttcattcttgctactgattgtccctgcatatgtcctgtcccaggttactctgaaagagtctggccctgggatattgcagccctcccagaccctcagtctgacttgttctttctctgggttttcactgagcacttctggtatgagtgtaggctggattcgtcagccttcagggaagggtctggagtggctggcacacatttggtgggatgatgacaagcgctataacccagccctgaagagccgactgacaatctccaaggatacctccagcaaccaggtattcctcaagatcgccagtgtggacactgcagatactgccacatactactgtgctcgttacagctctcgtgctatggactactggggtcaaggaacctcagtcaccgtctcctca

SEQ ID NO: 1250 - protein, 137 aa, Mus musculus
MGRLTSSFLLLIVPAYVLSQVTLKESGPGILQPSQTLSLTCSFSGFSLSTSGMSVGWIRQPSGKGLEWLAHIWWDDDKRYNPALKSRLTISKDTSSNQVFLKIASVDTADTATYYCARYSSRAMDYWGQGTSVTVSS

SEQ ID NO: 1251 - DNA, 327 bp, Mus musculus; identical to SEQ ID NO: 195

SEQ ID NO: 1252 - protein, 109 aa, Mus musculus; identical to SEQ ID NO: 52

SEQ ID NO: 1253 - DNA, 21 bp, Mus musculus
acttctggtatgagtgtaggc

SEQ ID NO: 1254 - protein, 7 aa, Mus musculus
TSGMSVG

SEQ ID NO: 1255 - DNA, 48 bp, Mus musculus
cacatttggtgggatgatgacaagcgctataacccagccctgaagagc

SEQ ID NO: 1256 - protein, 16 aa, Mus musculus
HIWWDDDKRYNPALKS

SEQ ID NO: 1257 - DNA, 24 bp, Mus musculus
tacagctctcgtgctatggactac

SEQ ID NO: 1258 - protein, 8 aa, Mus musculus
YSSRAMDY

SEQ ID NO: 1259 - DNA, 48 bp, Mus musculus; identical to SEQ ID NO: 27

SEQ ID NO: 1260 - protein, 16 aa, Mus musculus
RSSQSIVHSNGNTYLE

SEQ ID NO: 1261 - DNA, 21 bp, Mus musculus
aaagtttccaaccgattttct

SEQ ID NO: 1262 - protein, 7 aa, Mus musculus
KVSNRFS

SEQ ID NO: 1263 - DNA, 27 bp, Mus musculus
tttcaaggttcacatgttccgctcacg

SEQ ID NO: 1264 - protein, 9 aa, Mus musculus
FQGSHVPLT

SEQ ID NO: 1265 - DNA, 384 bp, Mus musculus
atggcagtggttacaggggtcaattcagaggttcagctgcagcagtctggggcagagcttgtgaagccaggggcctcagtcaagttgtcctgcacagcttctggcttcaacattaaagacacctatattcactgggtgaagcagaggcctgaacagggcctggagtggattggaaggattgatcctgcgaatggtaatactaaatatgacccgaagttccagggcaaggccactataacagcagacacatcctccatcacagcctgcctgcagctcagcagcctgacatctgaggacactgccgtctattactgtgctagaaggatctacggtagtggcctttttgcttactggggccaagggactctggtcactgtctctgca

SEQ ID NO: 1266 - protein, 128 aa, Mus musculus
MAVVTGVNSEVQLQQSGAELVKPGASVKLSCTASGFNIKDTYIHWVKQRPEQGLEWIGRIDPANGNTKYDPKFQGKATITADTSSITACLQLSSLTSEDTAVYYCARRIYGSGLFAYWGQGTLVTVSA

SEQ ID NO: 1267 - DNA, 279 bp, Mus musculus
atgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagctggagctgaaa

SEQ ID NO: 1268 - protein, 93 aa, Mus musculus
MSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 1269 - DNA, 15 bp, Mus musculus
gacacctatattcac

SEQ ID NO: 1270 - protein, 5 aa, Mus musculus
DTYIH

SEQ ID NO: 1271 - DNA, 51 bp, Mus musculus
aggattgatcctgcgaatggtaatactaaatatgacccgaagttccagggc

SEQ ID NO: 1272 - protein, 17 aa, Mus musculus
RIDPANGNTKYDPKFQG

SEQ ID NO: 1273 - DNA, 30 bp, Mus musculus
aggatctacggtagtggcctttttgcttac

SEQ ID NO: 1274 - protein, 10 aa, Mus musculus
RIYGSGLFAY

SEQ ID NO: 1275 - DNA, 51 bp, Mus musculus
aagtccagtcagagtctgttaaacagtggaaatcaaaagaactacttgacc

SEQ ID NO: 1276 - protein, 17 aa, Mus musculus
KSSQSLLNSGNQKNYLT

SEQ ID NO: 1277 - DNA, 21 bp, Mus musculus
tgggcatccactagggaatct

SEQ ID NO: 1278 - protein, 7 aa, Mus musculus
WASTRES

SEQ ID NO: 1279 - DNA, 27 bp, Mus musculus
cagaatgattatagttatccgctcacg

SEQ ID NO: 1280 - protein, 9 aa, Mus musculus
QNDYSYPLT

SEQ ID NO: 1281 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggaactgggacgggggctatggactactggggtcaaggaacctcagtcaccgtctcctca

SEQ ID NO: 1282 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTGTGAMDYWGQGTSVTVSS

SEQ ID NO: 1283 - DNA, 327 bp, Mus musculus; identical to SEQ ID NO: 595

SEQ ID NO: 1284 - protein, 109 aa, Mus musculus; identical to SEQ ID NO: 596

SEQ ID NO: 1285 - DNA, 15 bp, Mus musculus
agctttggaatgcac

SEQ ID NO: 1286 - protein, 5 aa, Mus musculus
SFGMH

SEQ ID NO: 1287 - DNA, 51 bp, Mus musculus; identical to SEQ ID NO: 119

SEQ ID NO: 1288 - protein, 17 aa, Mus musculus
YISSGSSTIYYADTVKG

SEQ ID NO: 1289 - DNA, 30 bp, Mus musculus
tcgggaactgggacgggggctatggactac

SEQ ID NO: 1290 - protein, 10 aa, Mus musculus
SGTGTGAMDY

SEQ ID NO: 1291 - DNA, 48 bp, Mus musculus; identical to SEQ ID NO: 43

SEQ ID NO: 1292 - protein, 16 aa, Mus musculus
RSSQSLVHSNGNTYLH

SEQ ID NO: 1293 - DNA, 21 bp, Mus musculus
aaagtttccaaccgattttct

SEQ ID NO: 1294 - protein, 7 aa, Mus musculus
KVSNRFS

SEQ ID NO: 1295 - DNA, 27 bp, Mus musculus
tctcaaagtacacatgttccgtggacg

SEQ ID NO: 1296 - protein, 9 aa, Mus musculus
SQSTHVPWT

SEQ ID NO: 1297 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagggggctaccgttattactatgctatggactactggggtcaaggaacctcagtcaccgtctcctca

SEQ ID NO: 1298 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGYRYYYAMDYWGQGTSVTVSS

SEQ ID NO: 1299 - DNA, 327 bp, Mus musculus; identical to SEQ ID NO: 51

SEQ ID NO: 1300 - protein, 109 aa, Mus musculus; identical to SEQ ID NO: 52

SEQ ID NO: 1301 - DNA, 15 bp, Mus musculus
agctttggaatgcac

SEQ ID NO: 1302 - protein, 5 aa, Mus musculus
SFGMH

SEQ ID NO: 1303 - DNA, 51 bp, Mus musculus; identical to SEQ ID NO: 119

SEQ ID NO: 1304 - protein, 17 aa, Mus musculus
YISSGSSTIYYADTVKG

SEQ ID NO: 1305 - DNA, 36 bp, Mus musculus
tcagggggctaccgttattactatgctatggactac

SEQ ID NO: 1306 - protein, 12 aa, Mus musculus
SGGYRYYYAMDY

SEQ ID NO: 1307 - DNA, 48 bp, Mus musculus; identical to SEQ ID NO: 27

SEQ ID NO: 1308 - protein, 16 aa, Mus musculus
RSSQSIVHSNGNTYLE

SEQ ID NO: 1309 - DNA, 21 bp, Mus musculus
aaagtttccaaccgattttct

SEQ ID NO: 1310 - protein, 7 aa, Mus musculus
KVSNRFS

SEQ ID NO: 1311 - DNA, 27 bp, Mus musculus
tttcaaggttcacatgttccgctcacg

SEQ ID NO: 1312 - protein, 9 aa, Mus musculus
FQGSHVPLT

SEQ ID NO: 1313 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgatctcgctatggtaattttgcttactggggccaagggactctggtcactgtctctgca

SEQ ID NO: 1314 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARSRYGNFAYWGQGTLVTVSA

SEQ ID NO: 1315 - DNA, 327 bp, Mus musculus; identical to SEQ ID NO: 51

SEQ ID NO: 1316 - protein, 109 aa, Mus musculus; identical to SEQ ID NO: 52

SEQ ID NO: 1317 - DNA, 21 bp, Mus musculus
acttctggtatgggtgtgagc

SEQ ID NO: 1318 - protein, 7 aa, Mus musculus
TSGMGVS

SEQ ID NO: 1319 - DNA, 48 bp, Mus musculus; identical to SEQ ID NO: 39

SEQ ID NO: 1320 - protein, 16 aa, Mus musculus
HIYWDDDKRYNPSLKS

SEQ ID NO: 1321 - DNA, 24 bp, Mus musculus
tctcgctatggtaattttgcttac

SEQ ID NO: 1322 - protein, 8 aa, Mus musculus
SRYGNFAY

SEQ ID NO: 1323 - DNA, 48 bp, Mus musculus; identical to SEQ ID NO: 27

SEQ ID NO: 1324 - protein, 16 aa, Mus musculus
RSSQSIVHSNGNTYLE

SEQ ID NO: 1325 - DNA, 21 bp, Mus musculus
aaagtttccaaccgattttct

SEQ ID NO: 1326 - protein, 7 aa, Mus musculus
KVSNRFS

SEQ ID NO: 1327 - DNA, 27 bp, Mus musculus
tttcaaggttcacatgttccgctcacg

SEQ ID NO: 1328 - protein, 9 aa, Mus musculus
FQGSHVPLT

SEQ ID NO: 1329 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattggggctcaaactgggaaaccttgactactggggccaaggcaccactctcacagtctcctca

SEQ ID NO: 1330 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGLKLGNLDYWGQGTTLTVSS

SEQ ID NO: 1331 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccattcacgttcggctcggggacaaagttggaaataaaa

SEQ ID NO: 1332 - protein, 109 aa, Mus musculus
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK

SEQ ID NO: 1333 - DNA, 15 bp, Mus musculus
agctttggaatgcac

SEQ ID NO: 1334 - protein, 5 aa, Mus musculus
SFGMH

SEQ ID NO: 1335 - DNA, 51 bp, Mus musculus; identical to SEQ ID NO: 119

SEQ ID NO: 1336 - protein, 17 aa, Mus musculus
YISSGSSTIYYADTVKG

SEQ ID NO: 1337 - DNA, 30 bp, Mus musculus
ttggggctcaaactgggaaaccttgactac

SEQ ID NO: 1338 - protein, 10 aa, Mus musculus
LGLKLGNLDY

SEQ ID NO: 1339 - DNA, 48 bp, Mus musculus; identical to SEQ ID NO: 43

SEQ ID NO: 1340 - protein, 16 aa, Mus musculus
RSSQSLVHSNGNTYLH

SEQ ID NO: 1341 - DNA, 21 bp, Mus musculus
aaagtttccaaccgattttct

SEQ ID NO: 1342 - protein, 7 aa, Mus musculus
KVSNRFS

SEQ ID NO: 1343 - DNA, 27 bp, Mus musculus
tctcaaagtacacatgttccattcacg

SEQ ID NO: 1344 - protein, 9 aa, Mus musculus
SQSTHVPFT

SEQ ID NO: 1345 - DNA, 321 bp, Mus musculus
atgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcggggcccctctggttacgaccgggcctggtttgcttactggggccaagggactctggtcactgtctctgca

SEQ ID NO: 1346 - protein, 107 aa, Mus musculus
MKLSCVASGFTFSNYWMNWVRQSPEKGLEWVAEIRLKSNNYATHYAESVKGRFTISRDDSKSSVYLQMNNLRAEDTGIYYCTRRGPSGYDRAWFAYWGQGTLVTVSA

SEQ ID NO: 1347 - DNA, 279 bp, Mus musculus
atgagctgcaagtccagtcagagccttttatatagtagcaatcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtggacgttcggtggaggcaccaagctggaaatcaaa

SEQ ID NO: 1348 - protein, 93 aa, Mus musculus
MSCKSSQSLLYSSNQKNYLAWYQQKPGQSPKLLIYWASTRESGVPDRFTGSGSGTDFTLTISSVKAEDLAVYYCQQYYSYPWTFGGGTKLEIK

SEQ ID NO: 1349 - DNA, 15 bp, Mus musculus
aactactggatgaac

SEQ ID NO: 1350 - protein, 5 aa, Mus musculus
NYWMN

SEQ ID NO: 1351 - DNA, 57 bp, Mus musculus
gaaattagattgaaatctaataattatgcaacacattatgcggagtctgtgaaaggg

SEQ ID NO: 1352 - protein, 19 aa, Mus musculus
EIRLKSNNYATHYAESVKG

SEQ ID NO: 1353 - DNA, 39 bp, Mus musculus
cggggcccctctggttacgaccgggcctggtttgcttac

SEQ ID NO: 1354 - protein, 13 aa, Mus musculus
RGPSGYDRAWFAY

SEQ ID NO: 1355 - DNA, 51 bp, Mus musculus
aagtccagtcagagccttttatatagtagcaatcaaaagaactacttggcc

SEQ ID NO: 1356 - protein, 17 aa, Mus musculus
KSSQSLLYSSNQKNYLA

SEQ ID NO: 1357 - DNA, 21 bp, Mus musculus
tgggcatccactagggaatct

SEQ ID NO: 1358 - protein, 7 aa, Mus musculus
WASTRES

SEQ ID NO: 1359 - DNA, 27 bp, Mus musculus
cagcaatattatagctatccgtggacg

SEQ ID NO: 1360 - protein, 9 aa, Mus musculus
QQYYSYPWT

SEQ ID NO: 1361 - DNA, 429 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctccccgtctttactacggctacgatgctatggactactggggtcaaggaacctcagtcaccgtctcctca

SEQ ID NO: 1362 - protein, 143 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAPRLYYGYDAMDYWGQGTSVTVSS

SEQ ID NO: 1363 - DNA, 327 bp, Mus musculus; identical to SEQ ID NO: 51

SEQ ID NO: 1364 - protein, 109 aa, Mus musculus; identical to SEQ ID NO: 52

SEQ ID NO: 1365 - DNA, 21 bp, Mus musculus
acttctggtatgggtgtgagc

SEQ ID NO: 1366 - protein, 7 aa, Mus musculus
TSGMGVS

SEQ ID NO: 1367 - DNA, 48 bp, Mus musculus; identical to SEQ ID NO: 39

SEQ ID NO: 1368 - protein, 16 aa, Mus musculus
HIYWDDDKRYNPSLKS

SEQ ID NO: 1369 - DNA, 42 bp, Mus musculus
agagctccccgtctttactacggctacgatgctatggactac

SEQ ID NO: 1370 - protein, 14 aa, Mus musculus
RAPRLYYGYDAMDY

SEQ ID NO: 1371 - DNA, 48 bp, Mus musculus; identical to SEQ ID NO: 27

SEQ ID NO: 1372 - protein, 16 aa, Mus musculus
RSSQSIVHSNGNTYLE

SEQ ID NO: 1373 - DNA, 21 bp, Mus musculus
aaagtttccaaccgattttct

SEQ ID NO: 1374 - protein, 7 aa, Mus musculus
KVSNRFS

SEQ ID NO: 1375 - DNA, 27 bp, Mus musculus
tttcaaggttcacatgttccgctcacg

SEQ ID NO: 1376 - protein, 9 aa, Mus musculus
FQGSHVPLT

SEQ ID NO: 1377 - DNA, 420 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagaggactacggctacgggacgctatggactactggggtcaaggaacctcagtcaccgtctcctca

SEQ ID NO: 1378 - protein, 140 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLRLRDAMDYWGQGTSVTVSS

SEQ ID NO: 1379 - DNA, 327 bp, Mus musculus; identical to SEQ ID NO: 51

SEQ ID NO: 1380 - protein, 109 aa, Mus musculus; identical to SEQ ID NO: 52

SEQ ID NO: 1381 - DNA, 21 bp, Mus musculus
acttctggtatgggtgtgagc

SEQ ID NO: 1382 - protein, 7 aa, Mus musculus
TSGMGVS

SEQ ID NO: 1383 - DNA, 48 bp, Mus musculus; identical to SEQ ID NO: 39

SEQ ID NO: 1384 - protein, 16 aa, Mus musculus
HIYWDDDKRYNPSLKS

SEQ ID NO: 1385 - DNA, 33 bp, Mus musculus
agaggactacggctacgggacgctatggactac

SEQ ID NO: 1386 - protein, 11 aa, Mus musculus
RGLRLRDAMDY

SEQ ID NO: 1387 - DNA, 48 bp, Mus musculus; identical to SEQ ID NO: 27

SEQ ID NO: 1388 - protein, 16 aa, Mus musculus
RSSQSIVHSNGNTYLE

SEQ ID NO: 1389 - DNA, 21 bp, Mus musculus
aaagtttccaaccgattttct

SEQ ID NO: 1390 - protein, 7 aa, Mus musculus
KVSNRFS

SEQ ID NO: 1391 - DNA, 27 bp, Mus musculus
tttcaaggttcacatgttccgctcacg

SEQ ID NO: 1392 - protein, 9 aa, Mus musculus
FQGSHVPLT

SEQ ID NO: 1393 - DNA, 411 bp, Mus musculus; identical to SEQ ID NO: 1313

SEQ ID NO: 1394 - protein, 137 aa, Mus musculus; identical to SEQ ID NO: 1314

SEQ ID NO: 1395 - DNA, 327 bp, Mus musculus; identical to SEQ ID NO: 51

SEQ ID NO: 1396 - protein, 109 aa, Mus musculus; identical to SEQ ID NO: 52

SEQ ID NO: 1397 - DNA, 21 bp, Mus musculus
acttctggtatgggtgtgagc

SEQ ID NO: 1398 - protein, 7 aa, Mus musculus
TSGMGVS

SEQ ID NO: 1399 - DNA, 48 bp, Mus musculus; identical to SEQ ID NO: 39

SEQ ID NO: 1400 - protein, 16 aa, Mus musculus
HIYWDDDKRYNPSLKS

SEQ ID NO: 1401 - DNA, 24 bp, Mus musculus
tctcgctatggtaattttgcttac

SEQ ID NO: 1402 - protein, 8 aa, Mus musculus
SRYGNFAY

SEQ ID NO: 1403 - DNA, 48 bp, Mus musculus; identical to SEQ ID NO: 27

SEQ ID NO: 1404 - protein, 16 aa, Mus musculus
RSSQSIVHSNGNTYLE

SEQ ID NO: 1405 - DNA, 21 bp, Mus musculus
aaagtttccaaccgattttct

SEQ ID NO: 1406 - protein, 7 aa, Mus musculus
KVSNRFS

SEQ ID NO: 1407 - DNA, 27 bp, Mus musculus
tttcaaggttcacatgttccgctcacg

SEQ ID NO: 1408 - protein, 9 aa, Mus musculus
FQGSHVPLT

SEQ ID NO: 1409 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagctacggtagtagctacggggggacctttgactactggggccaaggcaccactctcacagtctcctca

SEQ ID NO: 1410 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGSSYGGTFDYWGQGTTLTVSS

SEQ ID NO: 1411 - DNA, 327 bp, Mus musculus; identical to SEQ ID NO: 867

SEQ ID NO: 1412 - protein, 109 aa, Mus musculus; identical to SEQ ID NO: 36

SEQ ID NO: 1413 - DNA, 15 bp, Mus musculus
agctttggaatgcac

SEQ ID NO: 1414 - protein, 5 aa, Mus musculus
SFGMH

SEQ ID NO: 1415 - DNA, 51 bp, Mus musculus; identical to SEQ ID NO: 119

SEQ ID NO: 1416 - protein, 17 aa, Mus musculus
YISSGSSTIYYADTVKG

SEQ ID NO: 1417 - DNA, 33 bp, Mus musculus
tacggtagtagctacggggggacctttgactac

SEQ ID NO: 1418 - protein, 11 aa, Mus musculus
YGSSYGGTFDY

SEQ ID NO: 1419 - DNA, 48 bp, Mus musculus; identical to SEQ ID NO: 43

SEQ ID NO: 1420 - protein, 16 aa, Mus musculus
RSSQSLVHSNGNTYLH

SEQ ID NO: 1421 - DNA, 21 bp, Mus musculus
aaagtttccaaccgattttct

SEQ ID NO: 1422 - protein, 7 aa, Mus musculus
KVSNRFS

SEQ ID NO: 1423 - DNA, 27 bp, Mus musculus
tctcaaagtacacatgttccgctcacg

SEQ ID NO: 1424 - protein, 9 aa, Mus musculus
SQSTHVPLT

SEQ ID NO: 1425 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctacggtctgaggacacggccatgtattactgtgcaagatcggaactccttgcttattggggccaagggactctggtcactgtctctgca

SEQ ID NO: 1426 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSELLAYWGQGTLVTVSA

SEQ ID NO: 1427 - DNA, 327 bp, Mus musculus; identical to SEQ ID NO: 1171

SEQ ID NO: 1428 - protein, 109 aa, Mus musculus; identical to SEQ ID NO: 484

SEQ ID NO: 1429 - DNA, 15 bp, Mus musculus
agctttggaatgcac

SEQ ID NO: 1430 - protein, 5 aa, Mus musculus
SFGMH

SEQ ID NO: 1431 - DNA, 51 bp, Mus musculus; identical to SEQ ID NO: 119

SEQ ID NO: 1432 - protein, 17 aa, Mus musculus
YISSGSSTIYYADTVKG

SEQ ID NO: 1433 - DNA, 18 bp, Mus musculus
tcggaactccttgcttat

SEQ ID NO: 1434 - protein, 6 aa, Mus musculus
SELLAY

SEQ ID NO: 1435 - DNA, 48 bp, Mus musculus; identical to SEQ ID NO: 491

SEQ ID NO: 1436 - protein, 16 aa, Mus musculus
RSSQSLENSNGNTYLN

SEQ ID NO: 1437 - DNA, 21 bp, Mus musculus
agggtttccaaccgattttct

SEQ ID NO: 1438 - protein, 7 aa, Mus musculus
RVSNRFS

SEQ ID NO: 1439 - DNA, 27 bp, Mus musculus
ctccaagttacacatgtccctcccacg

SEQ ID NO: 1440 - protein, 9 aa, Mus musculus
LQVTHVPPT

SEQ ID NO: 1441 - DNA, 420 bp, Mus musculus; identical to SEQ ID NO: 1377

SEQ ID NO: 1442 - protein, 140 aa, Mus musculus; identical to SEQ ID NO: 1378

SEQ ID NO: 1443 - DNA, 327 bp, Mus musculus; identical to SEQ ID NO: 51

SEQ ID NO: 1444 - protein, 109 aa, Mus musculus; identical to SEQ ID NO: 52

SEQ ID NO: 1445 - DNA, 21 bp, Mus musculus
acttctggtatgggtgtgagc

SEQ ID NO: 1446 - protein, 7 aa, Mus musculus
TSGMGVS

SEQ ID NO: 1447 - DNA, 48 bp, Mus musculus; identical to SEQ ID NO: 39

SEQ ID NO: 1448 - protein, 16 aa, Mus musculus
HIYWDDDKRYNPSLKS

SEQ ID NO: 1449 - DNA, 33 bp, Mus musculus; identical to SEQ ID NO: 1385

SEQ ID NO: 1450 - protein, 11 aa, Mus musculus
RGLRLRDAMDY

SEQ ID NO: 1451 - DNA, 48 bp, Mus musculus; identical to SEQ ID NO: 27

SEQ ID NO: 1452 - protein, 16 aa, Mus musculus
RSSQSIVHSNGNTYLE

SEQ ID NO: 1453 - DNA, 21 bp, Mus musculus
aaagtttccaaccgattttct

SEQ ID NO: 1454 - protein, 7 aa, Mus musculus
KVSNRFS

SEQ ID NO: 1455 - DNA, 27 bp, Mus musculus
tttcaaggttcacatgttccgctcacg

SEQ ID NO: 1456 - protein, 9 aa, Mus musculus
FQGSHVPLT

SEQ ID NO: 1457 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctagaactgggttggactactggggtcaaggaacctcagtcaccgtctcctca

SEQ ID NO: 1458 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRARTGLDYWGQGTSVTVSS

SEQ ID NO: 1459 - DNA, 327 bp, Mus musculus; identical to SEQ ID NO: 51

SEQ ID NO: 1460 - protein, 109 aa, Mus musculus; identical to SEQ ID NO: 52

SEQ ID NO: 1461 - DNA, 21 bp, Mus musculus
acttctggtatgggtgtgagc

SEQ ID NO: 1462 - protein, 7 aa, Mus musculus
TSGMGVS

SEQ ID NO: 1463 - DNA, 48 bp, Mus musculus; identical to SEQ ID NO: 39

SEQ ID NO: 1464 - protein, 16 aa, Mus musculus
HIYWDDDKRYNPSLKS

SEQ ID NO: 1465 - DNA, 24 bp, Mus musculus
agagctagaactgggttggactac

SEQ ID NO: 1466 - protein, 8 aa, Mus musculus
RARTGLDY

SEQ ID NO: 1467 - DNA, 48 bp, Mus musculus; identical to SEQ ID NO: 27

SEQ ID NO: 1468 - protein, 16 aa, Mus musculus
RSSQSIVHSNGNTYLE

SEQ ID NO: 1469 - DNA, 21 bp, Mus musculus
aaagtttccaaccgattttct

SEQ ID NO: 1470 - protein, 7 aa, Mus musculus
KVSNRFS

SEQ ID NO: 1471 - DNA, 27 bp, Mus musculus
tttcaaggttcacatgttccgctcacg

SEQ ID NO: 1472 - protein, 9 aa, Mus musculus
FQGSHVPLT

SEQ ID NO: 1473 - DNA, 396 bp, Mus musculus
atgggatggagctatatcatcctctttttggtagcaacagctacagatgtccactcccaggtccaactgcagcagcctggggctgaactggtgaagcctggggcttcagtgaagctgtcctgcaaggcttctggctacaccttcaccagctactggatgcactgggtgaagcagaggcctggacaaggcctcgagtggattggagagattaatcctagcaacggtcgtactaactacaatgagaagttcaagagcaaggccacactgactgtagacaaatcctccagcacagcctacatgcaactcagcagcctgacatctgaggactctgcggtctattactgtgcaagatacgatgcttactggggccaagggactctggtcactgtctctgca

SEQ ID NO: 1474 - protein, 132 aa, Mus musculus
MGWSYIILFLVATATDVHSQVQLQQPGAELVKPGASVKLSCKASGYTFTSYWMHWVKQRPGQGLEWIGEINPSNGRTNYNEKFKSKATLTVDKSSSTAYMQLSSLTSEDSAVYYCARYDAYWGQGTLVTVSA

SEQ ID NO: 1475 - DNA, 327 bp, Mus musculus; identical to SEQ ID NO: 227

SEQ ID NO: 1476 - protein, 109 aa, Mus musculus; identical to SEQ ID NO: 52

SEQ ID NO: 1477 - DNA, 15 bp, Mus musculus
agctactggatgcac

SEQ ID NO: 1478 - protein, 5 aa, Mus musculus
SYWMH

SEQ ID NO: 1479 - DNA, 51 bp, Mus musculus
gagattaatcctagcaacggtcgtactaactacaatgagaagttcaagagc

SEQ ID NO: 1480 - protein, 17 aa, Mus musculus
EINPSNGRTNYNEKFKS

SEQ ID NO: 1481 - DNA, 12 bp, Mus musculus
tacgatgcttac

SEQ ID NO: 1482 - protein, 4 aa, Mus musculus
YDAY

SEQ ID NO: 1483 - DNA, 48 bp, Mus musculus; identical to SEQ ID NO: 27

SEQ ID NO: 1484 - protein, 16 aa, Mus musculus
RSSQSIVHSNGNTYLE

SEQ ID NO: 1485 - DNA, 21 bp, Mus musculus
aaagtttccaaccgattttct

SEQ ID NO: 1486 - protein, 7 aa, Mus musculus
KVSNRFS

SEQ ID NO: 1487 - DNA, 27 bp, Mus musculus
tttcaaggttcacatgttcctctcacg

SEQ ID NO: 1488 - protein, 9 aa, Mus musculus
FQGSHVPLT

SEQ ID NO: 1489 - DNA, 414 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagtccccgcggtacctcgtttgcttactggggccaagggactctggtcactgtctctgca

SEQ ID NO: 1490 - protein, 138 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARSPRGTSFAYWGQGTLVTVSA

SEQ ID NO: 1491 - DNA, 327 bp, Mus musculus; identical to SEQ ID NO: 51

SEQ ID NO: 1492 - protein, 109 aa, Mus musculus; identical to SEQ ID NO: 52

SEQ ID NO: 1493 - DNA, 21 bp, Mus musculus
acttctggtatgggtgtgagc

SEQ ID NO: 1494 - protein, 7 aa, Mus musculus
TSGMGVS

SEQ ID NO: 1495 - DNA, 48 bp, Mus musculus; identical to SEQ ID NO: 39

SEQ ID NO: 1496 - protein, 16 aa, Mus musculus
HIYWDDDKRYNPSLKS

SEQ ID NO: 1497 - DNA, 27 bp, Mus musculus
agtccccgcggtacctcgtttgcttac

SEQ ID NO: 1498 - protein, 9 aa, Mus musculus
SPRGTSFAY

SEQ ID NO: 1499 - DNA, 48 bp, Mus musculus; identical to SEQ ID NO: 27

SEQ ID NO: 1500 - protein, 16 aa, Mus musculus
RSSQSIVHSNGNTYLE

SEQ ID NO: 1501 - DNA, 21 bp, Mus musculus
aaagtttccaaccgattttct

SEQ ID NO: 1502 - protein, 7 aa, Mus musculus
KVSNRFS

SEQ ID NO: 1503 - DNA, 27 bp, Mus musculus
tttcaaggttcacatgttccgctcacg

SEQ ID NO: 1504 - protein, 9 aa, Mus musculus
FQGSHVPLT

SEQ ID NO: 1505 - DNA, 405 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatacgggtatgctatggactactggggtcaaggaacctcagtcaccgtctcctca

SEQ ID NO: 1506 - protein, 135 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYAMDYWGQGTSVTVSS

SEQ ID NO: 1507 - DNA, 327 bp, Mus musculus; identical to SEQ ID NO: 243

SEQ ID NO: 1508 - protein, 109 aa, Mus musculus; identical to SEQ ID NO: 244

SEQ ID NO: 1509 - DNA, 15 bp, Mus musculus
agctttggaatgcac

SEQ ID NO: 1510 - protein, 5 aa, Mus musculus
SFGMH

SEQ ID NO: 1511 - DNA, 51 bp, Mus musculus; identical to SEQ ID NO: 119

SEQ ID NO: 1512 - protein, 17 aa, Mus musculus
YISSGSSTIYYADTVKG

SEQ ID NO: 1513 - DNA, 21 bp, Mus musculus
tacgggtatgctatggactac

SEQ ID NO: 1514 - protein, 7 aa, Mus musculus
YGYAMDY

SEQ ID NO: 1515 - DNA, 48 bp, Mus musculus; identical to SEQ ID NO: 27

SEQ ID NO: 1516 - protein, 16 aa, Mus musculus
RSSQSIVHSNGNTYLE

SEQ ID NO: 1517 - DNA, 21 bp, Mus musculus
aaagtttccaaccgattttct

SEQ ID NO: 1518 - protein, 7 aa, Mus musculus
KVSNRFS

SEQ ID NO: 1519 - DNA, 27 bp, Mus musculus
tttcaaggttcacatgttcctccgacg

SEQ ID NO: 1520 - protein, 9 aa, Mus musculus
FQGSHVPPT

SEQ ID NO: 1521 - DNA, 420 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaggattacgacgaggggactactttgactactggggccaaggcaccactctcacagtctcctca

SEQ ID NO: 1522 - protein, 140 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGLRRGDYFDYWGQGTTLTVSS

SEQ ID NO: 1523 - DNA, 327 bp, Mus musculus; identical to SEQ ID NO: 51

SEQ ID NO: 1524 - protein, 109 aa, Mus musculus; identical to SEQ ID NO: 52

SEQ ID NO: 1525 - DNA, 21 bp, Mus musculus
acttctggtatgggtgtaggc

SEQ ID NO: 1526 - protein, 7 aa, Mus musculus
TSGMGVG

SEQ ID NO: 1527 - DNA, 48 bp, Mus musculus; identical to SEQ ID NO: 103

SEQ ID NO: 1528 - protein, 16 aa, Mus musculus
HIWWDDDKYYNPSLKS

SEQ ID NO: 1529 - DNA, 33 bp, Mus musculus
agaggattacgacgaggggactactttgactac

SEQ ID NO: 1530 - protein, 11 aa, Mus musculus
RGLRRGDYFDY

SEQ ID NO: 1531 - DNA, 48 bp, Mus musculus; identical to SEQ ID NO: 27

SEQ ID NO: 1532 - protein, 16 aa, Mus musculus
RSSQSIVHSNGNTYLE

SEQ ID NO: 1533 - DNA, 21 bp, Mus musculus
aaagtttccaaccgattttct

SEQ ID NO: 1534 - protein, 7 aa, Mus musculus
KVSNRFS

SEQ ID NO: 1535 - DNA, 27 bp, Mus musculus
tttcaaggttcacatgttccgctcacg

SEQ ID NO: 1536 - protein, 9 aa, Mus musculus
FQGSHVPLT

SEQ ID NO: 1537 - DNA, 408 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcggtattactatgctatggactactggggtcaaggaacctcagtcaccgtctcctca

SEQ ID NO: 1538 - protein, 136 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYYYAMDYWGQGTSVTVSS

SEQ ID NO: 1539 - DNA, 327 bp, Mus musculus; identical to SEQ ID NO: 51

SEQ ID NO: 1540 - protein, 109 aa, Mus musculus; identical to SEQ ID NO: 52

SEQ ID NO: 1541 - DNA, 21 bp, Mus musculus
acttctggtatgggtgtgagc

SEQ ID NO: 1542 - protein, 7 aa, Mus musculus
TSGMGVS

SEQ ID NO: 1543 - DNA, 48 bp, Mus musculus; identical to SEQ ID NO: 39

SEQ ID NO: 1544 - protein, 16 aa, Mus musculus
HIYWDDDKRYNPSLKS

SEQ ID NO: 1545 - DNA, 21 bp, Mus musculus
tattactatgctatggactac

SEQ ID NO: 1546 - protein, 7 aa, Mus musculus
YYYAMDY

SEQ ID NO: 1547 - DNA, 48 bp, Mus musculus; identical to SEQ ID NO: 27

SEQ ID NO: 1548 - protein, 16 aa, Mus musculus
RSSQSIVHSNGNTYLE

SEQ ID NO: 1549 - DNA, 21 bp, Mus musculus
aaagtttccaaccgattttct

SEQ ID NO: 1550 - protein, 7 aa, Mus musculus
KVSNRFS

SEQ ID NO: 1551 - DNA, 27 bp, Mus musculus
tttcaaggttcacatgttccgctcacg

SEQ ID NO: 1552 - protein, 9 aa, Mus musculus
FQGSHVPLT

SEQ ID NO: 1553 - DNA, 405 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagttatggtaactacggggcttactggggccaagggactctggtcactgtctctgca

SEQ ID NO: 1554 - protein, 135 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGNYGAYWGQGTLVTVSA

SEQ ID NO: 1555 - DNA, 327 bp, Mus musculus; identical to SEQ ID NO: 243

SEQ ID NO: 1556 - protein, 109 aa, Mus musculus; identical to SEQ ID NO: 244

SEQ ID NO: 1557 - DNA, 15 bp, Mus musculus
agctttggaatgcac

SEQ ID NO: 1558 - protein, 5 aa, Mus musculus
SFGMH

SEQ ID NO: 1559 - DNA, 51 bp, Mus musculus; identical to SEQ ID NO: 119

SEQ ID NO: 1560 - protein, 17 aa, Mus musculus
YISSGSSTIYYADTVKG

SEQ ID NO: 1561 - DNA, 21 bp, Mus musculus
tatggtaactacggggcttac

SEQ ID NO: 1562 - protein, 7 aa, Mus musculus
YGNYGAY

SEQ ID NO: 1563 - DNA, 48 bp, Mus musculus; identical to SEQ ID NO: 27

SEQ ID NO: 1564 - protein, 16 aa, Mus musculus
RSSQSIVHSNGNTYLE

SEQ ID NO: 1565 - DNA, 21 bp, Mus musculus
aaagtttccaaccgattttct

SEQ ID NO: 1566 - protein, 7 aa, Mus musculus
KVSNRFS

SEQ ID NO: 1567 - DNA, 27 bp, Mus musculus
tttcaaggttcacatgttcctccgacg

SEQ ID NO: 1568 - protein, 9 aa, Mus musculus
FQGSHVPPT

SEQ ID NO: 1569 - DNA, 423 bp, Mus musculus
atggacaggcttacttcttcattcctgctgctgattgtccctgcatatgtcttgtcccaagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaaggagcatgattacgacgaatgactactttgactactggggccaaggcaccactctcacagtctcctca

SEQ ID NO: 1570 - protein, 141 aa, Mus musculus
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRSMITTNDYFDYWGQGTTLTVSS

SEQ ID NO: 1571 - DNA, 327 bp, Mus musculus; identical to SEQ ID NO: 243

SEQ ID NO: 1572 - protein, 109 aa, Mus musculus; identical to SEQ ID NO: 244

SEQ ID NO: 1573 - DNA, 21 bp, Mus musculus
acttctggtatgggtgtaggc

SEQ ID NO: 1574 - protein, 7 aa, Mus musculus
TSGMGVG

SEQ ID NO: 1575 - DNA, 48 bp, Mus musculus; identical to SEQ ID NO: 103

SEQ ID NO: 1576 - protein, 16 aa, Mus musculus
HIWWDDDKYYNPSLKS

SEQ ID NO: 1577 - DNA, 36 bp, Mus musculus
aggagcatgattacgacgaatgactactttgactac

SEQ ID NO: 1578 - protein, 12 aa, Mus musculus
RSMITTNDYFDY

SEQ ID NO: 1579 - DNA, 48 bp, Mus musculus; identical to SEQ ID NO: 27

SEQ ID NO: 1580 - protein, 16 aa, Mus musculus
RSSQSIVHSNGNTYLE

SEQ ID NO: 1581 - DNA, 21 bp, Mus musculus
aaagtttccaaccgattttct

SEQ ID NO: 1582 - protein, 7 aa, Mus musculus
KVSNRFS

SEQ ID NO: 1583 - DNA, 27 bp, Mus musculus
tttcaaggttcacatgttcctccgacg

SEQ ID NO: 1584 - protein, 9 aa, Mus musculus
FQGSHVPPT

SEQ ID NO: 1585 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatgggtactatgctatggactactggggtcaaggaacctcagtcaccgtctcctca

SEQ ID NO: 1586 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYAMDYWGQGTSVTVSS

SEQ ID NO: 1587 - DNA, 327 bp, Mus musculus; identical to SEQ ID NO: 243

SEQ ID NO: 1588 - protein, 109 aa, Mus musculus; identical to SEQ ID NO: 244

SEQ ID NO: 1589 - DNA, 15 bp, Mus musculus
agctttggaatgcac

SEQ ID NO: 1590 - protein, 5 aa, Mus musculus
SFGMH

SEQ ID NO: 1591 - DNA, 51 bp, Mus musculus; identical to SEQ ID NO: 119

SEQ ID NO: 1592 - protein, 17 aa, Mus musculus
YISSGSSTIYYADTVKG

SEQ ID NO: 1593 - DNA, 24 bp, Mus musculus
tatgggtactatgctatggactac

SEQ ID NO: 1594 - protein, 8 aa, Mus musculus
YGYYAMDY

SEQ ID NO: 1595 - DNA, 48 bp, Mus musculus; identical to SEQ ID NO: 27

SEQ ID NO: 1596 - protein, 16 aa, Mus musculus
RSSQSIVHSNGNTYLE

SEQ ID NO: 1597 - DNA, 21 bp, Mus musculus
aaagtttccaaccgattttct

SEQ ID NO: 1598 - protein, 7 aa, Mus musculus
KVSNRFS

SEQ ID NO: 1599 - DNA, 27 bp, Mus musculus
tttcaaggttcacatgttcctccgacg

SEQ ID NO: 1600 - protein, 9 aa, Mus musculus
FQGSHVPPT

SEQ ID NO: 1601 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtacaagatccgactatggtaactcctttgcttactggggccaagggactctggtcactgtctctgca

SEQ ID NO: 1602 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCTRSDYGNSFAYWGQGTLVTVSA

SEQ ID NO: 1603 - DNA, 327 bp, Mus musculus; identical to SEQ ID NO: 867

SEQ ID NO: 1604 - protein, 109 aa, Mus musculus; identical to SEQ ID NO: 36

SEQ ID NO: 1605 - DNA, 15 bp, Mus musculus
agctttggaatgcac

SEQ ID NO: 1606 - protein, 5 aa, Mus musculus
SFGMH

SEQ ID NO: 1607 - DNA, 51 bp, Mus musculus; identical to SEQ ID NO: 119

SEQ ID NO: 1608 - protein, 17 aa, Mus musculus
YISSGSSTIYYADTVKG

SEQ ID NO: 1609 - DNA, 27 bp, Mus musculus
tccgactatggtaactcctttgcttac

SEQ ID NO: 1610 - protein, 9 aa, Mus musculus
SDYGNSFAY

SEQ ID NO: 1611 - DNA, 48 bp, Mus musculus; identical to SEQ ID NO: 43

SEQ ID NO: 1612 - protein, 16 aa, Mus musculus
RSSQSLVHSNGNTYLH

SEQ ID NO: 1613 - DNA, 21 bp, Mus musculus
aaagtttccaaccgattttct

SEQ ID NO: 1614 - protein, 7 aa, Mus musculus
KVSNRFS

SEQ ID NO: 1615 - DNA, 27 bp, Mus musculus
tctcaaagtacacatgttccgctcacg

SEQ ID NO: 1616 - protein, 9 aa, Mus musculus
SQSTHVPLT

SEQ ID NO: 1617 - DNA, 414 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgcctctggtacgacggcggtcctgcttactggggccaagggactctggtcactgtctctgca

SEQ ID NO: 1618 - protein, 138 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARLWYDGGPAYWGQGTLVTVSA

SEQ ID NO: 1619 - DNA, 327 bp, Mus musculus; identical to SEQ ID NO: 867

SEQ ID NO: 1620 - protein, 109 aa, Mus musculus; identical to SEQ ID NO: 36

SEQ ID NO: 1621 - DNA, 21 bp, Mus musculus
acttctggtatgggtgtgagc

SEQ ID NO: 1622 - protein, 7 aa, Mus musculus
TSGMGVS

SEQ ID NO: 1623 - DNA, 48 bp, Mus musculus; identical to SEQ ID NO: 39

SEQ ID NO: 1624 - protein, 16 aa, Mus musculus
HIYWDDDKRYNPSLKS

SEQ ID NO: 1625 - DNA, 27 bp, Mus musculus
ctctggtacgacggcggtcctgcttac

SEQ ID NO: 1626 - protein, 9 aa, Mus musculus
LWYDGGPAY

SEQ ID NO: 1627 - DNA, 48 bp, Mus musculus; identical to SEQ ID NO: 43

SEQ ID NO: 1628 - protein, 16 aa, Mus musculus
RSSQSLVHSNGNTYLH

SEQ ID NO: 1629 - DNA, 21 bp, Mus musculus
aaagtttccaaccgattttct

SEQ ID NO: 1630 - protein, 7 aa, Mus musculus
KVSNRFS

SEQ ID NO: 1631 - DNA, 27 bp, Mus musculus
tctcaaagtacacatgttccgctcacg

SEQ ID NO: 1632 - protein, 9 aa, Mus musculus
SQSTHVPLT

SEQ ID NO: 1633 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgatatggttacgacgctatggactactggggtcaaggaacctcagtcaccgtctcctca

SEQ ID NO: 1634 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYGYDAMDYWGQGTSVTVSS

SEQ ID NO: 1635 - DNA, 327 bp, Mus musculus; identical to SEQ ID NO: 867

SEQ ID NO: 1636 - protein, 109 aa, Mus musculus; identical to SEQ ID NO: 36

SEQ ID NO: 1637 - DNA, 21 bp, Mus musculus
acttctggtatgggtgtgagc

SEQ ID NO: 1638 - protein, 7 aa, Mus musculus
TSGMGVS

SEQ ID NO: 1639 - DNA, 48 bp, Mus musculus; identical to SEQ ID NO: 39

SEQ ID NO: 1640 - protein, 16 aa, Mus musculus
HIYWDDDKRYNPSLKS

SEQ ID NO: 1641 - DNA, 24 bp, Mus musculus
tatggttacgacgctatggactac

SEQ ID NO: 1642 - protein, 8 aa, Mus musculus
YGYDAMDY

SEQ ID NO: 1643 - DNA, 48 bp, Mus musculus; identical to SEQ ID NO: 43

SEQ ID NO: 1644 - protein, 16 aa, Mus musculus
RSSQSLVHSNGNTYLH

SEQ ID NO: 1645 - DNA, 21 bp, Mus musculus
aaagtttccaaccgattttct

SEQ ID NO: 1646 - protein, 7 aa, Mus musculus
KVSNRFS

SEQ ID NO: 1647 - DNA, 27 bp, Mus musculus
tctcaaagtacacatgttccgctcacg

SEQ ID NO: 1648 - protein, 9 aa, Mus musculus
SQSTHVPLT

SEQ ID NO: 1649 - DNA, 411 bp, Mus musculus
atggctgtcctggggctgcttctctgcctggtgactttcccaagctgtgtcctgtcccaggtgcagctgaaggagtcaggacctggcctggtggcgccctcacagagcctgtccatcacatgcaccatctcagggttctcattaaccagctatggtgtacactgggttcgccagcctccaggaaagggtctggagtggctggtagtgatatggagtgatggaagcacaacctataattcagctctcaaatccagactgagcatcagcaaggacaactccaagagccaacttttcttaaaaatgaacagtctccaaactgatgacacagccatgtactactgtgccagacatagctataggtacggtcttatggactactggggtcaaggaacctcagtcaccgtctcctca

SEQ ID NO: 1650 - protein, 137 aa, Mus musculus
MAVLGLLLCLVTFPSCVLSQVQLKESGPGLVAPSQSLSITCTISGFSLTSYGVHWVRQPPGKGLEWLVVIWSDGSTTYNSALKSRLSISKDNSKSQLFLKMNSLQTDDTAMYYCARHSYRYGLMDYWGQGTSVTVSS

SEQ ID NO: 1651 - DNA, 327 bp, Mus musculus; identical to SEQ ID NO: 1107

SEQ ID NO: 1652 - protein, 109 aa, Mus musculus; identical to SEQ ID NO: 36

SEQ ID NO: 1653 - DNA, 15 bp, Mus musculus
agctatggtgtacac

SEQ ID NO: 1654 - protein, 5 aa, Mus musculus
SYGVH

SEQ ID NO: 1655 - DNA, 48 bp, Mus musculus
gtgatatggagtgatggaagcacaacctataattcagctctcaaatcc

SEQ ID NO: 1656 - protein, 16 aa, Mus musculus
VIWSDGSTTYNSALKS

SEQ ID NO: 1657 - DNA, 30 bp, Mus musculus
catagctataggtacggtcttatggactac

SEQ ID NO: 1658 - protein, 10 aa, Mus musculus
HSYRYGLMDY

SEQ ID NO: 1659 - DNA, 48 bp, Mus musculus; identical to SEQ ID NO: 43

SEQ ID NO: 1660 - protein, 16 aa, Mus musculus
RSSQSLVHSNGNTYLH

SEQ ID NO: 1661 - DNA, 21 bp, Mus musculus
aaagtttccaaccgattttct

SEQ ID NO: 1662 - protein, 7 aa, Mus musculus
KVSNRFS

SEQ ID NO: 1663 - DNA, 27 bp, Mus musculus
tctcaaagtacacatgttcctctcacg

SEQ ID NO: 1664 - protein, 9 aa, Mus musculus
SQSTHVPLT

SEQ ID NO: 1665 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattattgtgcaatcccaaggactgggacgggggctatggactactggggtcaaggaacctcagtcaccgtctcctca

SEQ ID NO: 1666 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIPRTGTGAMDYWGQGTSVTVSS

SEQ ID NO: 1667 - DNA, 327 bp, Mus musculus; identical to SEQ ID NO: 867

SEQ ID NO: 1668 - protein, 109 aa, Mus musculus; identical to SEQ ID NO: 36

SEQ ID NO: 1669 - DNA, 15 bp, Mus musculus
agctttggaatgcac

SEQ ID NO: 1670 - protein, 5 aa, Mus musculus
SFGMH

SEQ ID NO: 1671 - DNA, 51 bp, Mus musculus; identical to SEQ ID NO: 119

SEQ ID NO: 1672 - protein, 17 aa, Mus musculus
YISSGSSTIYYADTVKG

SEQ ID NO: 1673 - DNA, 30 bp, Mus musculus
ccaaggactgggacgggggctatggactac

SEQ ID NO: 1674 - protein, 10 aa, Mus musculus
PRTGTGAMDY

SEQ ID NO: 1675 - DNA, 48 bp, Mus musculus; identical to SEQ ID NO: 43

SEQ ID NO: 1676 - protein, 16 aa, Mus musculus
RSSQSLVHSNGNTYLH

SEQ ID NO: 1677 - DNA, 21 bp, Mus musculus
aaagtttccaaccgattttct

SEQ ID NO: 1678 - protein, 7 aa, Mus musculus
KVSNRFS

SEQ ID NO: 1679 - DNA, 27 bp, Mus musculus
tctcaaagtacacatgttccgctcacg

SEQ ID NO: 1680 - protein, 9 aa, Mus musculus
SQSTHVPLT

SEQ ID NO: 1681 - DNA, 429 bp, Mus musculus
atgaacaggctcacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggattatgacaagcgctataacccatccctgaagagccggctcacaatctccaaggatacctccaacaaccaggtattcctcaagatcaccagtgtggacactgcagatactgccacatactactgtgctcgaagaaaggtaactgggacgttggggctcgatgctatggactactggggtcaaggaacctcagtcaccgtctcctca

SEQ ID NO: 1682 - protein, 143 aa, Mus musculus
MNRLTSSLLLLIVPAYVLSQVTLKESGPGILQPSQTLSLTCSFSGFSLSTSGMGVSWIRQPSGKGLEWLAHIYWDYDKRYNPSLKSRLTISKDTSNNQVFLKITSVDTADTATYYCARRKVTGTLGLDAMDYWGQGTSVTVSS

SEQ ID NO: 1683 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaatcaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacttgttcctcccacgttcggtgctgggaccaagctggagctgaaa

SEQ ID NO: 1684 - protein, 109 aa, Mus musculus
MTQTPLSLPVSLGDQASISCRSSQSIVHSNGNTYLEWYLQKSGQSPKLLIYKVSNRFSGVPDRFSGSGSGTDFTLKISRVEAEDLGVYYCFQGSLVPPTFGAGTKLELK

SEQ ID NO: 1685 - DNA, 21 bp, Mus musculus
acttctggtatgggtgtgagc

SEQ ID NO: 1686 - protein, 7 aa, Mus musculus
TSGMGVS

SEQ ID NO: 1687 - DNA, 48 bp, Mus musculus
cacatttactgggattatgacaagcgctataacccatccctgaagagc

SEQ ID NO: 1688 - protein, 16 aa, Mus musculus
HIYWDYDKRYNPSLKS

SEQ ID NO: 1689 - DNA, 42 bp, Mus musculus
agaaaggtaactgggacgttggggctcgatgctatggactac

SEQ ID NO: 1690 - protein, 14 aa, Mus musculus
RKVTGTLGLDAMDY

SEQ ID NO: 1691 - DNA, 48 bp, Mus musculus; identical to SEQ ID NO: 27

SEQ ID NO: 1692 - protein, 16 aa, Mus musculus
RSSQSIVHSNGNTYLE

SEQ ID NO: 1693 - DNA, 21 bp, Mus musculus
aaagtttccaaccgattttct

SEQ ID NO: 1694 - protein, 7 aa, Mus musculus
KVSNRFS

SEQ ID NO: 1695 - DNA, 27 bp, Mus musculus
tttcaaggttcacttgttcctcccacg

SEQ ID NO: 1696 - protein, 9 aa, Mus musculus
FQGSLVPPT

SEQ ID NO: 1697 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaacctatgggatctatgctatggactactggggtcaaggaacctcagtcaccgtctcctca

SEQ ID NO: 1698 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCATYGIYAMDYWGQGTSVTVSS

SEQ ID NO: 1699 - DNA, 327 bp, Mus musculus; identical to SEQ ID NO: 243

SEQ ID NO: 1700 - protein, 109 aa, Mus musculus; identical to SEQ ID NO: 244

SEQ ID NO: 1701 - DNA, 15 bp, Mus musculus
agctttggaatgcac

SEQ ID NO: 1702 - protein, 5 aa, Mus musculus
SFGMH

SEQ ID NO: 1703 - DNA, 51 bp, Mus musculus; identical to SEQ ID NO: 119

SEQ ID NO: 1704 - protein, 17 aa, Mus musculus
YISSGSSTIYYADTVKG

SEQ ID NO: 1705 - DNA, 24 bp, Mus musculus
tatgggatctatgctatggactac

SEQ ID NO: 1706 - protein, 8 aa, Mus musculus
YGIYAMDY

SEQ ID NO: 1707 - DNA, 48 bp, Mus musculus; identical to SEQ ID NO: 27

SEQ ID NO: 1708 - protein, 16 aa, Mus musculus
RSSQSIVHSNGNTYLE

SEQ ID NO: 1709 - DNA, 21 bp, Mus musculus
aaagtttccaaccgattttct

SEQ ID NO: 1710 - protein, 7 aa, Mus musculus
KVSNRFS

SEQ ID NO: 1711 - DNA, 27 bp, Mus musculus
tttcaaggttcacatgttcctccgacg

SEQ ID NO: 1712 - protein, 9 aa, Mus musculus
FQGSHVPPT

SEQ ID NO: 1713 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaactacggttactatgctatggactactggggtcaaggaacctcagtcaccgtctcctca

SEQ ID NO: 1714 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYGYYAMDYWGQGTSVTVSS

SEQ ID NO: 1715 - DNA, 327 bp, Mus musculus; identical to SEQ ID NO: 51

SEQ ID NO: 1716 - protein, 109 aa, Mus musculus; identical to SEQ ID NO: 52

SEQ ID NO: 1717 - DNA, 15 bp, Mus musculus
agctttggaatgcac

SEQ ID NO: 1718 - protein, 5 aa, Mus musculus
SFGMH

SEQ ID NO: 1719 - DNA, 51 bp, Mus musculus; identical to SEQ ID NO: 119

SEQ ID NO: 1720 - protein, 17 aa, Mus musculus
YISSGSSTIYYADTVKG

SEQ ID NO: 1721 - DNA, 33 bp, Mus musculus
tatggtaactacggttactatgctatggactac

SEQ ID NO: 1722 - protein, 11 aa, Mus musculus
YGNYGYYAMDY

SEQ ID NO: 1723 - DNA, 48 bp, Mus musculus; identical to SEQ ID NO: 27

SEQ ID NO: 1724 - protein, 16 aa, Mus musculus
RSSQSIVHSNGNTYLE

SEQ ID NO: 1725 - DNA, 21 bp, Mus musculus
aaagtttccaaccgattttct

SEQ ID NO: 1726 - protein, 7 aa, Mus musculus
KVSNRFS

SEQ ID NO: 1727 - DNA, 27 bp, Mus musculus
tttcaaggttcacatgttccgctcacg

SEQ ID NO: 1728 - protein, 9 aa, Mus musculus
FQGSHVPLT

SEQ ID NO: 1729 - DNA, 405 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagtagggggtacttcgatgtctggggcgcagggaccacggtcaccgtctcctca

SEQ ID NO: 1730 - protein, 135 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSRGYFDVWGAGTTVTVSS

SEQ ID NO: 1731 - DNA, 327 bp, Mus musculus; identical to SEQ ID NO: 243

SEQ ID NO: 1732 - protein, 109 aa, Mus musculus; identical to SEQ ID NO: 244

SEQ ID NO: 1733 - DNA, 15 bp, Mus musculus
agctttggaatgcac

SEQ ID NO: 1734 - protein, 5 aa, Mus musculus
SFGMH

SEQ ID NO: 1735 - DNA, 51 bp, Mus musculus; identical to SEQ ID NO: 119

SEQ ID NO: 1736 - protein, 17 aa, Mus musculus
YISSGSSTIYYADTVKG

SEQ ID NO: 1737 - DNA, 21 bp, Mus musculus
agtagggggtacttcgatgtc

SEQ ID NO: 1738 - protein, 7 aa, Mus musculus
SRGYFDV

SEQ ID NO: 1739 - DNA, 48 bp, Mus musculus; identical to SEQ ID NO: 27

SEQ ID NO: 1740 - protein, 16 aa, Mus musculus
RSSQSIVHSNGNTYLE

SEQ ID NO: 1741 - DNA, 21 bp, Mus musculus
aaagtttccaaccgattttct

SEQ ID NO: 1742 - protein, 7 aa, Mus musculus
KVSNRFS

SEQ ID NO: 1743 - DNA, 27 bp, Mus musculus
tttcaaggttcacatgttcctccgacg

SEQ ID NO: 1744 - protein, 9 aa, Mus musculus
FQGSHVPPT

SEQ ID NO: 1745 - DNA, 408 bp, Mus musculus
atggactccaggctcaatttagttttccttgtccttattttaaaaggtgtccagtgtgatgcgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaatttattactacggtagtagctactactggggccaaggcaccactctcacagtctcctca

SEQ ID NO: 1746 - protein, 136 aa, Mus musculus
MDSRLNLVFLVLILKGVQCDAQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIYYYGSSYYWGQGTTLTVSS

SEQ ID NO: 1747 - DNA, 327 bp, Mus musculus; identical to SEQ ID NO: 291

SEQ ID NO: 1748 - protein, 109 aa, Mus musculus; identical to SEQ ID NO: 292

SEQ ID NO: 1749 - DNA, 15 bp, Mus musculus
agctttggaatgcac

SEQ ID NO: 1750 - protein, 5 aa, Mus musculus
SFGMH

SEQ ID NO: 1751 - DNA, 51 bp, Mus musculus; identical to SEQ ID NO: 119

SEQ ID NO: 1752 - protein, 17 aa, Mus musculus
YISSGSSTIYYADTVKG

SEQ ID NO: 1753 - DNA, 24 bp, Mus musculus
tattactacggtagtagctactac

SEQ ID NO: 1754 - protein, 8 aa, Mus musculus
YYYGSSYY

SEQ ID NO: 1755 - DNA, 48 bp, Mus musculus; identical to SEQ ID NO: 27

SEQ ID NO: 1756 - protein, 16 aa, Mus musculus
RSSQSIVHSNGNTYLE

SEQ ID NO: 1757 - DNA, 21 bp, Mus musculus
aaagtttccaaccgattttct

SEQ ID NO: 1758 - protein, 7 aa, Mus musculus
KVSNRFS

SEQ ID NO: 1759 - DNA, 27 bp, Mus musculus
tttcaaggttcacatgttcctcccacg

SEQ ID NO: 1760 - protein, 9 aa, Mus musculus
FQGSHVPPT

SEQ ID NO: 1761 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagccggtggttactccctttcctatgctatggactactggggtcaaggaacctcagtcaccgtctcctca

SEQ ID NO: 1762 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAGGYSLSYAMDYWGQGTSVTVSS

SEQ ID NO: 1763 - DNA, 327 bp, Mus musculus; identical to SEQ ID NO: 243

SEQ ID NO: 1764 - protein, 109 aa, Mus musculus; identical to SEQ ID NO: 244

SEQ ID NO: 1765 - DNA, 15 bp, Mus musculus
agctttggaatgcac

SEQ ID NO: 1766 - protein, 5 aa, Mus musculus
SFGMH

SEQ ID NO: 1767 - DNA, 51 bp, Mus musculus; identical to SEQ ID NO: 119

SEQ ID NO: 1768 - protein, 17 aa, Mus musculus
YISSGSSTIYYADTVKG

SEQ ID NO: 1769 - DNA, 36 bp, Mus musculus
gccggtggttactccctttcctatgctatggactac

SEQ ID NO: 1770 - protein, 12 aa, Mus musculus
AGGYSLSYAMDY

SEQ ID NO: 1771 - DNA, 48 bp, Mus musculus; identical to SEQ ID NO: 27

SEQ ID NO: 1772 - protein, 16 aa, Mus musculus
RSSQSIVHSNGNTYLE

SEQ ID NO: 1773 - DNA, 21 bp, Mus musculus
aaagtttccaaccgattttct

SEQ ID NO: 1774 - protein, 7 aa, Mus musculus
KVSNRFS

SEQ ID NO: 1775 - DNA, 27 bp, Mus musculus
tttcaaggttcacatgttcctccgacg

SEQ ID NO: 1776 - protein, 9 aa, Mus musculus
FQGSHVPPT

SEQ ID NO: 1777 - DNA, 414 bp, Mus musculus; identical to SEQ ID NO: 1617

SEQ ID NO: 1778 - protein, 138 aa, Mus musculus; identical to SEQ ID NO: 1618

SEQ ID NO: 1779 - DNA, 327 bp, Mus musculus; identical to SEQ ID NO: 867

SEQ ID NO: 1780 - protein, 109 aa, Mus musculus; identical to SEQ ID NO: 36

SEQ ID NO: 1781 - DNA, 21 bp, Mus musculus
acttctggtatgggtgtgagc

SEQ ID NO: 1782 - protein, 7 aa, Mus musculus
TSGMGVS

SEQ ID NO: 1783 - DNA, 48 bp, Mus musculus; identical to SEQ ID NO: 39

SEQ ID NO: 1784 - protein, 16 aa, Mus musculus
HIYWDDDKRYNPSLKS

SEQ ID NO: 1785 - DNA, 27 bp, Mus musculus
ctctggtacgacggcggtcctgcttac

SEQ ID NO: 1786 - protein, 9 aa, Mus musculus
LWYDGGPAY

SEQ ID NO: 1787 - DNA, 48 bp, Mus musculus; identical to SEQ ID NO: 43

SEQ ID NO: 1788 - protein, 16 aa, Mus musculus
RSSQSLVHSNGNTYLH

SEQ ID NO: 1789 - DNA, 21 bp, Mus musculus
aaagtttccaaccgattttct

SEQ ID NO: 1790 - protein, 7 aa, Mus musculus
KVSNRFS

SEQ ID NO: 1791 - DNA, 27 bp, Mus musculus
tctcaaagtacacatgttccgctcacg

SEQ ID NO: 1792 - protein, 9 aa, Mus musculus
SQSTHVPLT

SEQ ID NO: 1793 - DNA, 420 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaaaggggacctactataggtacgacgcctttgactactggggccaaggcaccactctcacagtctcctca

SEQ ID NO: 1794 - protein, 140 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARKGTYYRYDAFDYWGQGTTLTVSS

SEQ ID NO: 1795 - DNA, 327 bp, Mus musculus; identical to SEQ ID NO: 243

SEQ ID NO: 1796 - protein, 109 aa, Mus musculus; identical to SEQ ID NO: 244

SEQ ID NO: 1797 - DNA, 15 bp, Mus musculus
agctttggaatgcac

SEQ ID NO: 1798 - protein, 5 aa, Mus musculus
SFGMH

SEQ ID NO: 1799 - DNA, 51 bp, Mus musculus; identical to SEQ ID NO: 119

SEQ ID NO: 1800 - protein, 17 aa, Mus musculus
YISSGSSTIYYADTVKG

SEQ ID NO: 1801 - DNA, 36 bp, Mus musculus
aaggggacctactataggtacgacgcctttgactac

SEQ ID NO: 1802 - protein, 12 aa, Mus musculus
KGTYYRYDAFDY

SEQ ID NO: 1803 - DNA, 48 bp, Mus musculus; identical to SEQ ID NO: 27

SEQ ID NO: 1804 - protein, 16 aa, Mus musculus
RSSQSIVHSNGNTYLE

SEQ ID NO: 1805 - DNA, 21 bp, Mus musculus
aaagtttccaaccgattttct

SEQ ID NO: 1806 - protein, 7 aa, Mus musculus
KVSNRFS

SEQ ID NO: 1807 - DNA, 27 bp, Mus musculus
tttcaaggttcacatgttcctccgacg

SEQ ID NO: 1808 - protein, 9 aa, Mus musculus
FQGSHVPPT

SEQ ID NO: 1809 - DNA, 402 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggacattttgactactggggccaaggcaccactctcacagtctcctca

SEQ ID NO: 1810 - protein, 134 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGHFDYWGQGTTLTVSS

SEQ ID NO: 1811 - DNA, 327 bp, Mus musculus; identical to SEQ ID NO: 339

SEQ ID NO: 1812 - protein, 109 aa, Mus musculus; identical to SEQ ID NO: 340

SEQ ID NO: 1813 - DNA, 15 bp, Mus musculus
agctttggaatgcac

SEQ ID NO: 1814 - protein, 5 aa, Mus musculus
SFGMH

SEQ ID NO: 1815 - DNA, 51 bp, Mus musculus; identical to SEQ ID NO: 119

SEQ ID NO: 1816 - protein, 17 aa, Mus musculus
YISSGSSTIYYADTVKG

SEQ ID NO: 1817 - DNA, 18 bp, Mus musculus
gagggacattttgactac

SEQ ID NO: 1818 - protein, 6 aa, Mus musculus
EGHFDY

SEQ ID NO: 1819 - DNA, 48 bp, Mus musculus; identical to SEQ ID NO: 43

SEQ ID NO: 1820 - protein, 16 aa, Mus musculus
RSSQSLVHSNGNTYLH

SEQ ID NO: 1821 - DNA, 21 bp, Mus musculus
aaagtttccaaccgattttct

SEQ ID NO: 1822 - protein, 7 aa, Mus musculus
KVSNRFS

SEQ ID NO: 1823 - DNA, 27 bp, Mus musculus
tctcaaagtacacatgttcctccgacg

SEQ ID NO: 1824 - protein, 9 aa, Mus musculus
SQSTHVPPT

SEQ ID NO: 1825 - DNA, 393 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtactaccatctactatgcagacacagtgaagggccgattcaccatctccagagacaatcccaagaacaccctattcctacaaatgaccagtctaaggtctgaggacacggccatgtattactgtggcggctttgcttactggggccaagggactctggtcactgtctctgca

SEQ ID NO: 1826 - protein, 131 aa, Mus musculus
MDSRLNLVFLVLILKGVQCDVQLVESGGGLVQPGGSRKLSCAASGFTFSSFGMHWVRQAPEKGLEWVAYISSGSTTIYYADTVKGRFTISRDNPKNTLFLQMTSLRSEDTAMYYCGGFAYWGQGTLVTVSA

SEQ ID NO: 1827 - DNA, 327 bp, Mus musculus; identical to SEQ ID NO: 291

SEQ ID NO: 1828 - protein, 109 aa, Mus musculus; identical to SEQ ID NO: 292

SEQ ID NO: 1829 - DNA, 15 bp, Mus musculus
agctttggaatgcac

SEQ ID NO: 1830 - protein, 5 aa, Mus musculus
SFGMH

SEQ ID NO: 1831 - DNA, 51 bp, Mus musculus
tacattagtagtggcagtactaccatctactatgcagacacagtgaagggc

SEQ ID NO: 1832 - protein, 17 aa, Mus musculus
YISSGSTTIYYADTVKG

SEQ ID NO: 1833 - DNA, 9 bp, Mus musculus
tttgcttac

SEQ ID NO: 1834 - protein, 3 aa, Mus musculus
FAY

SEQ ID NO: 1835 - DNA, 48 bp, Mus musculus; identical to SEQ ID NO: 27

SEQ ID NO: 1836 - protein, 16 aa, Mus musculus
RSSQSIVHSNGNTYLE

SEQ ID NO: 1837 - DNA, 21 bp, Mus musculus
aaagtttccaaccgattttct

SEQ ID NO: 1838 - protein, 7 aa, Mus musculus
KVSNRFS

SEQ ID NO: 1839 - DNA, 27 bp, Mus musculus
tttcaaggttcacatgttcctcccacg

SEQ ID NO: 1840 - protein, 9 aa, Mus musculus
FQGSHVPPT

SEQ ID NO: 1841 - DNA, 429 bp, Mus musculus
atgaacttggggctcagcttgattttccttgtccttgttttaaaaggtgtccagtgtgaagtgaagctggtggagtctgggggaggcttagtgcagcctggagggtccctgaaactctcctgtgcaacctctggattcactttcagtgactattacatgtattgggttcgccagactccagagaagaggctggagtgggtcgcatacattagtaatggtggtggtagcacctattatccagacactgtaaagggccgattcaccatctccagagacaatgccaagaacaccctgtacctgcaaatgagccgtctgaagtctgaggacacagccatgtattactgtgcaagagggacctcatacggtagtggccttcattactatgctatggactactggggtcaaggaacctcagtcaccgtctcctca

SEQ ID NO: 1842 - protein, 143 aa, Mus musculus
MNLGLSLIFLVLVLKGVQCEVKLVESGGGLVQPGGSLKLSCATSGFTFSDYYMYWVRQTPEKRLEWVAYISNGGGSTYYPDTVKGRFTISRDNAKNTLYLQMSRLKSEDTAMYYCARGTSYGSGLHYYAMDYWGQGTSVTVSS

SEQ ID NO: 1843 - DNA, 327 bp, Mus musculus
atggcccaaactccactctccctgcctgtcagtcttggagatcaagcctccatctcttgcagatctagtcagagacttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgctcacgttcggtgctgggaccaagctggagctgaaa

SEQ ID NO: 1844 - protein, 109 aa, Mus musculus
MAQTPLSLPVSLGDQASISCRSSQRLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 1845 - DNA, 15 bp, Mus musculus
gactattacatgtat

SEQ ID NO: 1846 - protein, 5 aa, Mus musculus
DYYMY

SEQ ID NO: 1847 - DNA, 51 bp, Mus musculus
tacattagtaatggtggtggtagcacctattatccagacactgtaaagggc

SEQ ID NO: 1848 - protein, 17 aa, Mus musculus
YISNGGGSTYYPDTVKG

SEQ ID NO: 1849 - DNA, 45 bp, Mus musculus
gggacctcatacggtagtggccttcattactatgctatggactac

SEQ ID NO: 1850 - protein, 15 aa, Mus musculus
GTSYGSGLHYYAMDY

SEQ ID NO: 1851 - DNA, 48 bp, Mus musculus
agatctagtcagagacttgtacacagtaatggaaacacctatttacat

SEQ ID NO: 1852 - protein, 16 aa, Mus musculus
RSSQRLVHSNGNTYLH

SEQ ID NO: 1853 - DNA, 21 bp, Mus musculus
aaagtttccaaccgattttct

SEQ ID NO: 1854 - protein, 7 aa, Mus musculus
KVSNRFS

SEQ ID NO: 1855 - DNA, 27 bp, Mus musculus
tctcaaagtacacatgttccgctcacg

SEQ ID NO: 1856 - protein, 9 aa, Mus musculus
SQSTHVPLT

SEQ ID NO: 1857 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatggtaactacgtaggctggtttgcttactggggccaagggactctggtcactgtctctgca

SEQ ID NO: 1858 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGNYVGWFAYWGQGTLVTVSA

SEQ ID NO: 1859 - DNA, 327 bp, Mus musculus; identical to SEQ ID NO: 867

SEQ ID NO: 1860 - protein, 109 aa, Mus musculus; identical to SEQ ID NO: 36

SEQ ID NO: 1861 - DNA, 15 bp, Mus musculus
agctttggaatgcac

SEQ ID NO: 1862 - protein, 5 aa, Mus musculus
SFGMH

SEQ ID NO: 1863 - DNA, 51 bp, Mus musculus; identical to SEQ ID NO: 119

SEQ ID NO: 1864 - protein, 17 aa, Mus musculus
YISSGSSTIYYADTVKG

SEQ ID NO: 1865 - DNA, 30 bp, Mus musculus
gatggtaactacgtaggctggtttgcttac

SEQ ID NO: 1866 - protein, 10 aa, Mus musculus
DGNYVGWFAY

SEQ ID NO: 1867 - DNA, 48 bp, Mus musculus; identical to SEQ ID NO: 43

SEQ ID NO: 1868 - protein, 16 aa, Mus musculus
RSSQSLVHSNGNTYLH

SEQ ID NO: 1869 - DNA, 21 bp, Mus musculus
aaagtttccaaccgattttct

SEQ ID NO: 1870 - protein, 7 aa, Mus musculus
KVSNRFS

SEQ ID NO: 1871 - DNA, 27 bp, Mus musculus
tctcaaagtacacatgttccgctcacg

SEQ ID NO: 1872 - protein, 9 aa, Mus musculus
SQSTHVPLT

SEQ ID NO: 1873 - DNA, 414 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagaggaaggtactatgctatggactactggggtcaaggaacctcagtcaccgtctcctca

SEQ ID NO: 1874 - protein, 138 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGRYYAMDYWGQGTSVTVSS

SEQ ID NO: 1875 - DNA, 327 bp, Mus musculus; identical to SEQ ID NO: 51

SEQ ID NO: 1876 - protein, 109 aa, Mus musculus; identical to SEQ ID NO: 52

SEQ ID NO: 1877 - DNA, 21 bp, Mus musculus
acttctggtatgggtgtgagc

SEQ ID NO: 1878 - protein, 7 aa, Mus musculus
TSGMGVS

SEQ ID NO: 1879 - DNA, 48 bp, Mus musculus; identical to SEQ ID NO: 39

SEQ ID NO: 1880 - protein, 16 aa, Mus musculus
HIYWDDDKRYNPSLKS

SEQ ID NO: 1881 - DNA, 27 bp, Mus musculus
agaggaaggtactatgctatggactac

SEQ ID NO: 1882 - protein, 9 aa, Mus musculus
RGRYYAMDY

SEQ ID NO: 1883 - DNA, 48 bp, Mus musculus; identical to SEQ ID NO: 27

SEQ ID NO: 1884 - protein, 16 aa, Mus musculus
RSSQSIVHSNGNTYLE

SEQ ID NO: 1885 - DNA, 21 bp, Mus musculus
aaagtttccaaccgattttct

SEQ ID NO: 1886 - protein, 7 aa, Mus musculus
KVSNRFS

SEQ ID NO: 1887 - DNA, 27 bp, Mus musculus
tttcaaggttcacatgttccgctcacg

SEQ ID NO: 1888 - protein, 9 aa, Mus musculus
FQGSHVPLT

SEQ ID NO: 1889 - DNA, 417 bp, Mus musculus
atgtacttgggactgaactgtgtattcatagtttttctcttaaaaggtgtccagagtgaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccagggcgcgacgagggtatgctatggactactggggtcaaggaacctcagtcaccgtctcctca

SEQ ID NO: 1890 - protein, 139 aa, Mus musculus
MYLGLNCVFIVFLLKGVQSEVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRARRGYAMDYWGQGTSVTVSS

SEQ ID NO: 1891 - DNA, 276 bp, Mus musculus
atgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatcccacgttcggaggggggaccaagctggaaataaaa

SEQ ID NO: 1892 - protein, 92 aa, Mus musculus
MSCKSSQSLLNSGNQKNYLTWYQQKPGQPPKLLIYWASTRESGVPDRFTGSGSGTDFTLTISSVQAEDLAVYYCQNDYSYPTFGGGTKLEIK

SEQ ID NO: 1893 - DNA, 15 bp, Mus musculus
aactactggatgaac

SEQ ID NO: 1894 - protein, 5 aa, Mus musculus
NYWMN

SEQ ID NO: 1895 - DNA, 57 bp, Mus musculus; identical to SEQ ID NO: 1351

SEQ ID NO: 1896 - protein, 19 aa, Mus musculus
EIRLKSNNYATHYAESVKG

SEQ ID NO: 1897 - DNA, 27 bp, Mus musculus
gcgcgacgagggtatgctatggactac

SEQ ID NO: 1898 - protein, 9 aa, Mus musculus
ARRGYAMDY

SEQ ID NO: 1899 - DNA, 51 bp, Mus musculus; identical to SEQ ID NO: 1275

SEQ ID NO: 1900 - protein, 17 aa, Mus musculus
KSSQSLLNSGNQKNYLT

SEQ ID NO: 1901 - DNA, 21 bp, Mus musculus
tgggcatccactagggaatct

SEQ ID NO: 1902 - protein, 7 aa, Mus musculus
WASTRES

SEQ ID NO: 1903 - DNA, 24 bp, Mus musculus
cagaatgattatagttatcccacg

SEQ ID NO: 1904 - protein, 8 aa, Mus musculus
QNDYSYPT

SEQ ID NO: 1905 - DNA, 300 bp, Mus musculus
atgtcctgcaaggcttctggctacacctttactagctactggatgcactgggtaaaacagaggcctggacagggtctggaatggattggatacattaatcctagcactggttatactgagtacaatcagaagttcaaggacaaggccacattgactgcagacaaatcctccagcacagcctacatgcaactgagcagcctgacatctgaggactctgcagtctattactgtgattactacggtagtagctacgggtacttcgatgtctggggcgcagggaccacggtcaccgtctcctca

SEQ ID NO: 1906 - protein, 100 aa, Mus musculus
MSCKASGYTFTSYWMHWVKQRPGQGLEWIGYINPSTGYTEYNQKFKDKATLTADKSSSTAYMQLSSLTSEDSAVYYCDYYGSSYGYFDVWGAGTTVTVSS

SEQ ID NO: 1907 - DNA, 327 bp, Mus musculus
atgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttttttctgctctcaaagtacacatgttccgctcacgttcggtgctgggaccaagctggagctgaaa

SEQ ID NO: 1908 - protein, 109 aa, Mus musculus
MTQTPLSLPVSLGDQASISCRSSQSLVHSNGNTYLHWYLQKPGQSPKLLIYKVSNRFSGVPDRFSGSGSGTDFTLKISRVEAEDLGVFFCSQSTHVPLTFGAGTKLELK

SEQ ID NO: 1909 - DNA, 15 bp, Mus musculus
agctactggatgcac

SEQ ID NO: 1910 - protein, 5 aa, Mus musculus
SYWMH

SEQ ID NO: 1911 - DNA, 51 bp, Mus musculus; identical to SEQ ID NO: 1111

SEQ ID NO: 1912 - protein, 17 aa, Mus musculus
YINPSTGYTEYNQKFKD

SEQ ID NO: 1913 - DNA, 30 bp, Mus musculus
tacggtagtagctacgggtacttcgatgtc

SEQ ID NO: 1914 - protein, 10 aa, Mus musculus
YGSSYGYFDV

SEQ ID NO: 1915 - DNA, 48 bp, Mus musculus; identical to SEQ ID NO: 43

SEQ ID NO: 1916 - protein, 16 aa, Mus musculus
RSSQSLVHSNGNTYLH

SEQ ID NO: 1917 - DNA, 21 bp, Mus musculus
aaagtttccaaccgattttct

SEQ ID NO: 1918 - protein, 7 aa, Mus musculus
KVSNRFS

SEQ ID NO: 1919 - DNA, 27 bp, Mus musculus
tctcaaagtacacatgttccgctcacg

SEQ ID NO: 1920 - protein, 9 aa, Mus musculus
SQSTHVPLT

SEQ ID NO: 1921 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagtaactacgtgatttactatgctatggactactggggtcaaggaacctcagtcaccgtctcctca

SEQ ID NO: 1922 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNYVIYYAMDYWGQGTSVTVSS

SEQ ID NO: 1923 - DNA, 327 bp, Mus musculus; identical to SEQ ID NO: 51

SEQ ID NO: 1924 - protein, 109 aa, Mus musculus; identical to SEQ ID NO: 52

SEQ ID NO: 1925 - DNA, 15 bp, Mus musculus
agctttggaatgcac

SEQ ID NO: 1926 - protein, 5 aa, Mus musculus
SFGMH

SEQ ID NO: 1927 - DNA, 51 bp, Mus musculus; identical to SEQ ID NO: 119

SEQ ID NO: 1928 - protein, 17 aa, Mus musculus
YISSGSSTIYYADTVKG

SEQ ID NO: 1929 - DNA, 33 bp, Mus musculus
agtaactacgtgatttactatgctatggactac

SEQ ID NO: 1930 - protein, 11 aa, Mus musculus
SNYVIYYAMDY

SEQ ID NO: 1931 - DNA, 48 bp, Mus musculus; identical to SEQ ID NO: 27

SEQ ID NO: 1932 - protein, 16 aa, Mus musculus
RSSQSIVHSNGNTYLE

SEQ ID NO: 1933 - DNA, 21 bp, Mus musculus
aaagtttccaaccgattttct

SEQ ID NO: 1934 - protein, 7 aa, Mus musculus
KVSNRFS

SEQ ID NO: 1935 - DNA, 27 bp, Mus musculus
tttcaaggttcacatgttccgctcacg

SEQ ID NO: 1936 - protein, 9 aa, Mus musculus
FQGSHVPLT

SEQ ID NO: 1937 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaatagggttcggttactactatgctatggactactggggtcaaggaacctcagtcaccgtctcctca

SEQ ID NO: 1938 - protein, 139 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIGFGYYYAMDYWGQGTSVTVSS

SEQ ID NO: 1939 - DNA, 327 bp, Mus musculus; identical to SEQ ID NO: 595

SEQ ID NO: 1940 - protein, 109 aa, Mus musculus; identical to SEQ ID NO: 596

SEQ ID NO: 1941 - DNA, 15 bp, Mus musculus
agctttggaatgcac

SEQ ID NO: 1942 - protein, 5 aa, Mus musculus
SFGMH

SEQ ID NO: 1943 - DNA, 51 bp, Mus musculus; identical to SEQ ID NO: 119

SEQ ID NO: 1944 - protein, 17 aa, Mus musculus
YISSGSSTIYYADTVKG

SEQ ID NO: 1945 - DNA, 33 bp, Mus musculus
atagggttcggttactactatgctatggactac

SEQ ID NO: 1946 - protein, 11 aa, Mus musculus
IGFGYYYAMDY

SEQ ID NO: 1947 - DNA, 48 bp, Mus musculus; identical to SEQ ID NO: 43

SEQ ID NO: 1948 - protein, 16 aa, Mus musculus
RSSQSLVHSNGNTYLH

SEQ ID NO: 1949 - DNA, 21 bp, Mus musculus
aaagtttccaaccgattttct

SEQ ID NO: 1950 - protein, 7 aa, Mus musculus
KVSNRFS

SEQ ID NO: 1951 - DNA, 27 bp, Mus musculus
tctcaaagtacacatgttccgtggacg

SEQ ID NO: 1952 - protein, 9 aa, Mus musculus
SQSTHVPWT

SEQ ID NO: 1953 - DNA, 399 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggytggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatgatggttactactggggccaaggcaccactctcacagtctcctca

SEQ ID NO: 1954 - protein, 133 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYDGYYWGQGTTLTVSS

SEQ ID NO: 1955 - DNA, 327 bp, Mus musculus; identical to SEQ ID NO: 51

SEQ ID NO: 1956 - protein, 109 aa, Mus musculus; identical to SEQ ID NO: 52

SEQ ID NO: 1957 - DNA, 15 bp, Mus musculus
agctttggaatgcac

SEQ ID NO: 1958 - protein, 5 aa, Mus musculus
SFGMH

SEQ ID NO: 1959 - DNA, 51 bp, Mus musculus; identical to SEQ ID NO: 119

SEQ ID NO: 1960 - protein, 17 aa, Mus musculus
YISSGSSTIYYADTVKG

SEQ ID NO: 1961 - DNA, 15 bp, Mus musculus
tatgatggttactac

SEQ ID NO: 1962 - protein, 5 aa, Mus musculus
YDGYY

SEQ ID NO: 1963 - DNA, 48 bp, Mus musculus; identical to SEQ ID NO: 27

SEQ ID NO: 1964 - protein, 16 aa, Mus musculus
RSSQSIVHSNGNTYLE

SEQ ID NO: 1965 - DNA, 21 bp, Mus musculus
aaagtttccaaccgattttct

SEQ ID NO: 1966 - protein, 7 aa, Mus musculus
KVSNRFS

SEQ ID NO: 1967 - DNA, 27 bp, Mus musculus
tttcaaggttcacatgttccgctcacg

SEQ ID NO: 1968 - protein, 9 aa, Mus musculus
FQGSHVPLT

SEQ ID NO: 1969 - DNA, 405 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgaggggtactttgactactggggccaaggcaccactctcacagtctcctca

SEQ ID NO: 1970 - protein, 135 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDEGYFDYWGQGTTLTVSS

SEQ ID NO: 1971 - DNA, 327 bp, Mus musculus; identical to SEQ ID NO: 867

SEQ ID NO: 1972 - protein, 109 aa, Mus musculus; identical to SEQ ID NO: 36

SEQ ID NO: 1973 - DNA, 15 bp, Mus musculus
agctttggaatgcac

SEQ ID NO: 1974 - protein, 5 aa, Mus musculus
SFGMH

SEQ ID NO: 1975 - DNA, 51 bp, Mus musculus; identical to SEQ ID NO: 119

SEQ ID NO: 1976 - protein, 17 aa, Mus musculus
YISSGSSTIYYADTVKG

SEQ ID NO: 1977 - DNA, 21 bp, Mus musculus
gatgaggggtactttgactac

SEQ ID NO: 1978 - protein, 7 aa, Mus musculus
DEGYFDY

SEQ ID NO: 1979 - DNA, 48 bp, Mus musculus; identical to SEQ ID NO: 43

SEQ ID NO: 1980 - protein, 16 aa, Mus musculus
RSSQSLVHSNGNTYLH

SEQ ID NO: 1981 - DNA, 21 bp, Mus musculus
aaagtttccaaccgattttct

SEQ ID NO: 1982 - protein, 7 aa, Mus musculus
KVSNRFS

SEQ ID NO: 1983 - DNA, 27 bp, Mus musculus
tctcaaagtacacatgttccgctcacg

SEQ ID NO: 1984 - protein, 9 aa, Mus musculus
SQSTHVPLT

SEQ ID NO: 1985 - DNA, 420 bp, Mus musculus; identical to SEQ ID NO: 1793

SEQ ID NO: 1986 - protein, 140 aa, Mus musculus; identical to SEQ ID NO: 1794

SEQ ID NO: 1987 - DNA, 327 bp, Mus musculus; identical to SEQ ID NO: 243

SEQ ID NO: 1988 - protein, 109 aa, Mus musculus; identical to SEQ ID NO: 244

SEQ ID NO: 1989 - DNA, 15 bp, Mus musculus
agctttggaatgcac

SEQ ID NO: 1990 - protein, 5 aa, Mus musculus
SFGMH

SEQ ID NO: 1991 - DNA, 51 bp, Mus musculus; identical to SEQ ID NO: 119

SEQ ID NO: 1992 - protein, 17 aa, Mus musculus
YISSGSSTIYYADTVKG

SEQ ID NO: 1993 - DNA, 36 bp, Mus musculus; identical to SEQ ID NO: 1801

SEQ ID NO: 1994 - protein, 12 aa, Mus musculus
KGTYYRYDAFDY

SEQ ID NO: 1995 - DNA, 48 bp, Mus musculus; identical to SEQ ID NO: 27

SEQ ID NO: 1996 - protein, 16 aa, Mus musculus
RSSQSIVHSNGNTYLE

SEQ ID NO: 1997 - DNA, 21 bp, Mus musculus
aaagtttccaaccgattttct

SEQ ID NO: 1998 - protein, 7 aa, Mus musculus
KVSNRFS

SEQ ID NO: 1999 - DNA, 27 bp, Mus musculus
tttcaaggttcacatgttcctccgacg

SEQ ID NO: 2000 - protein, 9 aa, Mus musculus
FQGSHVPPT

SEQ ID NO: 2001 - DNA, 411 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgcttcctatggtaagatcccctttgactactggggccaaggcaccactctcacagtctcctca

SEQ ID NO: 2002 - protein, 137 aa, Mus musculus
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCASYGKIPFDYWGQGTTLTVSS

SEQ ID NO: 2003 - DNA, 327 bp, Mus musculus; identical to SEQ ID NO: 867

SEQ ID NO: 2004 - protein, 109 aa, Mus musculus; identical to SEQ ID NO: 36

SEQ ID NO: 2005 - DNA, 21 bp, Mus musculus
acttctggtatgggtgtgagc

SEQ ID NO: 2006 - protein, 7 aa, Mus musculus
TSGMGVS

SEQ ID NO: 2007 - DNA, 48 bp, Mus musculus; identical to SEQ ID NO: 39

SEQ ID NO: 2008 - protein, 16 aa, Mus musculus
HIYWDDDKRYNPSLKS

SEQ ID NO: 2009 - DNA, 24 bp, Mus musculus
tatggtaagatcccctttgactac

SEQ ID NO: 2010 - protein, 8 aa, Mus musculus
YGKIPFDY

SEQ ID NO: 2011 - DNA, 48 bp, Mus musculus; identical to SEQ ID NO: 43

SEQ ID NO: 2012 - protein, 16 aa, Mus musculus
RSSQSLVHSNGNTYLH

SEQ ID NO: 2013 - DNA, 21 bp, Mus musculus
aaagtttccaaccgattttct

SEQ ID NO: 2014 - protein, 7 aa, Mus musculus
KVSNRFS

SEQ ID NO: 2015 - DNA, 27 bp, Mus musculus
tctcaaagtacacatgttccgctcacg

SEQ ID NO: 2016 - protein, 9 aa, Mus musculus
SQSTHVPLT

SEQ ID NO: 2017 - DNA, 414 bp, Mus musculus
atggacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagaactacgccttccctggtttgcttactggggccaagggactctggtcactgtctct

SEQ ID NO: 2018 - protein, 138 aa, Mus musculus
MDRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRELRLPWFAYWGQGTLVTVS

SEQ ID NO: 2019 - DNA, 327 bp, Mus musculus; identical to SEQ ID NO: 51

SEQ ID NO: 2020 - protein, 109 aa, Mus musculus; identical to SEQ ID NO: 52

SEQ ID NO: 2021 - DNA, 21 bp, Mus musculus
acttctggtatgggtgtgagc

SEQ ID NO: 2022 - protein, 7 aa, Mus musculus
TSGMGVS

SEQ ID NO: 2023 - DNA, 48 bp, Mus musculus; identical to SEQ ID NO: 39

SEQ ID NO: 2024 - protein, 16 aa, Mus musculus
HIYWDDDKRYNPSLKS

SEQ ID NO: 2025 - DNA, 30 bp, Mus musculus
agagaactacgccttccctggtttgcttac

SEQ ID NO: 2026 - protein, 10 aa, Mus musculus
RELRLPWFAY

SEQ ID NO: 2027 - DNA, 48 bp, Mus musculus; identical to SEQ ID NO: 27

SEQ ID NO: 2028 - protein, 16 aa, Mus musculus
RSSQSIVHSNGNTYLE

SEQ ID NO: 2029 - DNA, 21 bp, Mus musculus
aaagtttccaaccgattttct

SEQ ID NO: 2030 - protein, 7 aa, Mus musculus
KVSNRFS

SEQ ID NO: 2031 - DNA, 27 bp, Mus musculus
tttcaaggttcacatgttccgctcacg

SEQ ID NO: 2032 - protein, 9 aa, Mus musculus
FQGSHVPLT

SEQ ID NO: 2033 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaatctctcctgtgcagcctctggattcactttcagtagctttggaatgcactgggttcgtcaggctccagtgaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagcgactacggtagtagctcgtttgcttactggggccaagggactctggtcactgtctct

SEQ ID NO: 2034 - protein, 136 aa, Mus musculus
MDSRLNLVFLVLILKGVQCDVQLVESGGGLVQPGGSRNLSCAASGFTFSSFGMHWVRQAPVKGLEWVAYISSGSSTIYYADTVKGRFTISRDNPKNTLFLQMTSLRSEDTAMYYCASDYGSSSFAYWGQGTLVTVS

SEQ ID NO: 2035 - DNA, 327 bp, Mus musculus; identical to SEQ ID NO: 867

SEQ ID NO: 2036 - protein, 109 aa, Mus musculus; identical to SEQ ID NO: 36

SEQ ID NO: 2037 - DNA, 15 bp, Mus musculus
agctttggaatgcac

SEQ ID NO: 2038 - protein, 5 aa, Mus musculus
SFGMH

SEQ ID NO: 2039 - DNA, 51 bp, Mus musculus; identical to SEQ ID NO: 119

SEQ ID NO: 2040 - protein, 17 aa, Mus musculus
YISSGSSTIYYADTVKG

SEQ ID NO: 2041 - DNA, 27 bp, Mus musculus
gactacggtagtagctcgtttgcttac

SEQ ID NO: 2042 - protein, 9 aa, Mus musculus
DYGSSSFAY

SEQ ID NO: 2043 - DNA, 48 bp, Mus musculus; identical to SEQ ID NO: 43

SEQ ID NO: 2044 - protein, 16 aa, Mus musculus
RSSQSLVHSNGNTYLH

SEQ ID NO: 2045 - DNA, 21 bp, Mus musculus
aaagtttccaaccgattttct

SEQ ID NO: 2046 - protein, 7 aa, Mus musculus
KVSNRFS

SEQ ID NO: 2047 - DNA, 27 bp, Mus musculus
tctcaaagtacacatgttccgctcacg

SEQ ID NO: 2048 - protein, 9 aa, Mus musculus
SQSTHVPLT

SEQ ID NO: 2049 - DNA, 417 bp, Mus musculus
atgggatggagctatatcatcctctttttggtagcaacagctacaggtgtccactcccaggtccaactgcagcagcctggggctgaactggtgaagcctggggcttcagtgaagttgtcctgcaaggcttctggctacaccttcaccagctactatatgtactgggtgaagcagaggcctggacaaggccttgagtggattggggggattaatcctagcaatggtggtactaacttcaatgagaagttcaagagcaaggccacactgactgtagacaaatcctccagcacagcctacatgcaactcagcagcctgacatctgaggactctgcggtctattactgtacaagagagaggaaaattcattactacggctacgactactggggccaaggcaccactctcacagtctcctca

SEQ ID NO: 2050 - protein, 139 aa, Mus musculus
MGWSYIILFLVATATGVHSQVQLQQPGAELVKPGASVKLSCKASGYTFTSYYMYWVKQRPGQGLEWIGGINPSNGGTNFNEKFKSKATLTVDKSSSTAYMQLSSLTSEDSAVYYCTRERKIHYYGYDYWGQGTTLTVSS

SEQ ID NO: 2051 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtacacgttcggaggggggaccaagctggaaataaaa

SEQ ID NO: 2052 - protein, 109 aa, Mus musculus
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 2053 - DNA, 15 bp, Mus musculus
agctactatatgtac

SEQ ID NO: 2054 - protein, 5 aa, Mus musculus
SYYMY

SEQ ID NO: 2055 - DNA, 51 bp, Mus musculus
gggattaatcctagcaatggtggtactaacttcaatgagaagttcaagagc

SEQ ID NO: 2056 - protein, 17 aa, Mus musculus
GINPSNGGTNFNEKFKS

SEQ ID NO: 2057 - DNA, 33 bp, Mus musculus
gagaggaaaattcattactacggctacgactac

SEQ ID NO: 2058 - protein, 11 aa, Mus musculus
ERKIHYYGYDY

SEQ ID NO: 2059 - DNA, 48 bp, Mus musculus; identical to SEQ ID NO: 27

SEQ ID NO: 2060 - protein, 16 aa, Mus musculus
RSSQSIVHSNGNTYLE

SEQ ID NO: 2061 - DNA, 21 bp, Mus musculus
aaagtttccaaccgattttct

SEQ ID NO: 2062 - protein, 7 aa, Mus musculus
KVSNRFS

SEQ ID NO: 2063 - DNA, 27 bp, Mus musculus
tttcaaggttcacatgttccgtacacg

SEQ ID NO: 2064 - protein, 9 aa, Mus musculus
FQGSHVPYT

SEQ ID NO: 2065 - DNA, 414 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaatttactacggtagtagcggagcgtttgcttactggggccaagggactctggtcactgtctct

SEQ ID NO: 2066 - protein, 138 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIYYGSSGAFAYWGQGTLVTVS

SEQ ID NO: 2067 - DNA, 327 bp, Mus musculus
atgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggaggggggaccaagctggaaataaaa

SEQ ID NO: 2068 - protein, 109 aa, Mus musculus; identical to SEQ ID NO: 244

SEQ ID NO: 2069 - DNA, 15 bp, Mus musculus
agctttggaatgcac

SEQ ID NO: 2070 - protein, 5 aa, Mus musculus
SFGMH

SEQ ID NO: 2071 - DNA, 51 bp, Mus musculus; identical to SEQ ID NO: 119

SEQ ID NO: 2072 - protein, 17 aa, Mus musculus
YISSGSSTIYYADTVKG

SEQ ID NO: 2073 - DNA, 33 bp, Mus musculus
atttactacggtagtagcggagcgtttgcttac

SEQ ID NO: 2074 - protein, 11 aa, Mus musculus
IYYGSSGAFAY

SEQ ID NO: 2075 - DNA, 48 bp, Mus musculus; identical to SEQ ID NO: 27

SEQ ID NO: 2076 - protein, 16 aa, Mus musculus
RSSQSIVHSNGNTYLE

SEQ ID NO: 2077 - DNA, 21 bp, Mus musculus
aaagtttccaaccgattttct

SEQ ID NO: 2078 - protein, 7 aa, Mus musculus
KVSNRFS

SEQ ID NO: 2079 - DNA, 27 bp, Mus musculus
tttcaaggttcacatgttcctcccacg

SEQ ID NO: 2080 - protein, 9 aa, Mus musculus
FQGSHVPPT

SEQ ID NO: 2081 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaggggggacgggggctatggactactggggtcaaggaacctcagtcaccgtctcctca

SEQ ID NO: 2082 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGTGAMDYWGQGTSVTVSS

SEQ ID NO: 2083 - DNA, 327 bp, Mus musculus; identical to SEQ ID NO: 243

SEQ ID NO: 2084 - protein, 109 aa, Mus musculus; identical to SEQ ID NO: 244

SEQ ID NO: 2085 - DNA, 15 bp, Mus musculus
agctttggaatgcac

SEQ ID NO: 2086 - protein, 5 aa, Mus musculus
SFGMH

SEQ ID NO: 2087 - DNA, 51 bp, Mus musculus; identical to SEQ ID NO: 119

SEQ ID NO: 2088 - protein, 17 aa, Mus musculus
YISSGSSTIYYADTVKG

SEQ ID NO: 2089 - DNA, 24 bp, Mus musculus
ggggggacgggggctatggactac

SEQ ID NO: 2090 - protein, 8 aa, Mus musculus
GGTGAMDY

SEQ ID NO: 2091 - DNA, 48 bp, Mus musculus; identical to SEQ ID NO: 27

SEQ ID NO: 2092 - protein, 16 aa, Mus musculus
RSSQSIVHSNGNTYLE

SEQ ID NO: 2093 - DNA, 21 bp, Mus musculus
aaagtttccaaccgattttct

SEQ ID NO: 2094 - protein, 7 aa, Mus musculus
KVSNRFS

SEQ ID NO: 2095 - DNA, 27 bp, Mus musculus
tttcaaggttcacatgttcctccgacg

SEQ ID NO: 2096 - protein, 9 aa, Mus musculus
FQGSHVPPT

SEQ ID NO: 2097 - DNA, 414 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagctcggaggtacgctatggactactggggtcaaggaacctcagtcaccgtctcctca

SEQ ID NO: 2098 - protein, 138 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRARRYAMDYWGQGTSVTVSS

SEQ ID NO: 2099 - DNA, 327 bp, Mus musculus; identical to SEQ ID NO: 51

SEQ ID NO: 2100 - protein, 109 aa, Mus musculus; identical to SEQ ID NO: 52

SEQ ID NO: 2101 - DNA, 21 bp, Mus musculus
acttctggtatgggtgtgagc

SEQ ID NO: 2102 - protein, 7 aa, Mus musculus
TSGMGVS

SEQ ID NO: 2103 - DNA, 48 bp, Mus musculus; identical to SEQ ID NO: 39

SEQ ID NO: 2104 - protein, 16 aa, Mus musculus
HIYWDDDKRYNPSLKS

SEQ ID NO: 2105 - DNA, 27 bp, Mus musculus
agagctcggaggtacgctatggactac

SEQ ID NO: 2106 - protein, 9 aa, Mus musculus
RARRYAMDY

SEQ ID NO: 2107 - DNA, 48 bp, Mus musculus; identical to SEQ ID NO: 27

SEQ ID NO: 2108 - protein, 16 aa, Mus musculus
RSSQSIVHSNGNTYLE

SEQ ID NO: 2109 - DNA, 21 bp, Mus musculus
aaagtttccaaccgattttct

SEQ ID NO: 2110 - protein, 7 aa, Mus musculus
KVSNRFS

SEQ ID NO: 2111 - DNA, 27 bp, Mus musculus
tttcaaggttcacatgttccgctcacg

SEQ ID NO: 2112 - protein, 9 aa, Mus musculus
FQGSHVPLT

SEQ ID NO: 2113 - DNA, 408 bp, Mus musculus
atggacaggcttacttcctcattcctgctgctgattgtccctgcatatgtcctttcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctggggggtttgcttactggggccaagggactctggtcactgtctctgca

SEQ ID NO: 2114 - protein, 136 aa, Mus musculus; identical to SEQ ID NO: 882

SEQ ID NO: 2115 - DNA, 384 bp, Mus musculus
atggtattcacacctcatatccttggacttctgcttttctggatttcagcctccacaggtgacatcctgctgacccagtctccagccaccctgtctgtgactccaggagaaacagtcagtctttcctgtagggccagccagagtatttacaagaacctacactggtatcaacagaaatcacatcggtctccaaggcttctcatcaagtatgcttctgattccatctctgggatcccctccaggttcactggcagtggatcagggacagattacactctcagtatcaacagtgtgaagcccgaagatgaaggaatatattactgtcttcaaggttacagcacacccatgtacacgttcggaggggggaccaagctggaaataaaa

SEQ ID NO: 2116 - protein, 128 aa, Mus musculus
MVFTPHILGLLLFWISASTGDILLTQSPATLSVTPGETVSLSCRASQSIYKNLHWYQQKSHRSPRLLIKYASDSISGIPSRFTGSGSGTDYTLSINSVKPEDEGIYYCLQGYSTPMYTFGGGTKLEIK

SEQ ID NO: 2117 - DNA, 21 bp, Mus musculus
acttctggtatgggtgtgagc

SEQ ID NO: 2118 - protein, 7 aa, Mus musculus
TSGMGVS

SEQ ID NO: 2119 - DNA, 48 bp, Mus musculus; identical to SEQ ID NO: 39

SEQ ID NO: 2120 - protein, 16 aa, Mus musculus
HIYWDDDKRYNPSLKS

SEQ ID NO: 2121 - DNA, 21 bp, Mus musculus
agagctggggggtttgcttac

SEQ ID NO: 2122 - protein, 7 aa, Mus musculus
RAGGFAY

SEQ ID NO: 2123 - DNA, 33 bp, Mus musculus
agggccagccagagtatttacaagaacctacac

SEQ ID NO: 2124 - protein, 11 aa, Mus musculus
RASQSIYKNLH

SEQ ID NO: 2125 - DNA, 21 bp, Mus musculus
tatgcttctgattccatctct

SEQ ID NO: 2126 - protein, 7 aa, Mus musculus
YASDSIS

SEQ ID NO: 2127 - DNA, 30 bp, Mus musculus
cttcaaggttacagcacacccatgtacacg

SEQ ID NO: 2128 - protein, 10 aa, Mus musculus
LQGYSTPMYT

SEQ ID NO: 2129 - DNA, 405 bp, Mus musculus
atgaacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaggtagtaactttgactactggggccaaggcaccactctcacagtctcctca

SEQ ID NO: 2130 - protein, 135 aa, Mus musculus
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARGSNFDYWGQGTTLTVSS

SEQ ID NO: 2131 - DNA, 327 bp, Mus musculus; identical to SEQ ID NO: 867

SEQ ID NO: 2132 - protein, 109 aa, Mus musculus; identical to SEQ ID NO: 36

SEQ ID NO: 2133 - DNA, 21 bp, Mus musculus
acttctggtatgggtgtgagc

SEQ ID NO: 2134 - protein, 7 aa, Mus musculus
TSGMGVS

SEQ ID NO: 2135 - DNA, 48 bp, Mus musculus; identical to SEQ ID NO: 39

SEQ ID NO: 2136 - protein, 16 aa, Mus musculus
HIYWDDDKRYNPSLKS

SEQ ID NO: 2137 - DNA, 18 bp, Mus musculus
ggtagtaactttgactac

SEQ ID NO: 2138 - protein, 6 aa, Mus musculus
GSNFDY

SEQ ID NO: 2139 - DNA, 48 bp, Mus musculus; identical to SEQ ID NO: 43

SEQ ID NO: 2140 - protein, 16 aa, Mus musculus
RSSQSLVHSNGNTYLH

SEQ ID NO: 2141 - DNA, 21 bp, Mus musculus
aaagtttccaaccgattttct

SEQ ID NO: 2142 - protein, 7 aa, Mus musculus
KVSNRFS

SEQ ID NO: 2143 - DNA, 27 bp, Mus musculus
tctcaaagtacacatgttccgctcacg

SEQ ID NO: 2144 - protein, 9 aa, Mus musculus
SQSTHVPLT

SEQ ID NO: 2145 - DNA, 426 bp, Mus musculus
atggacaggcttacttcctcattgctgctgctgattgtccctgcatatgtcctgtcccaggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagaggggtctactataggtacgacgatgctatggactactggggtcaaggaacctcagtcaccgtctcctca

SEQ ID NO: 2146 - protein, 142 aa, Mus musculus
MDRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRGVYYRYDDAMDYWGQGTSVTVSS

SEQ ID NO: 2147 - DNA, 327 bp, Mus musculus; identical to SEQ ID NO: 51

SEQ ID NO: 2148 - protein, 109 aa, Mus musculus; identical to SEQ ID NO: 52

SEQ ID NO: 2149 - DNA, 21 bp, Mus musculus
acttctggtatgggtgtgagc

SEQ ID NO: 2150 - protein, 7 aa, Mus musculus
TSGMGVS

SEQ ID NO: 2151 - DNA, 48 bp, Mus musculus; identical to SEQ ID NO: 39

SEQ ID NO: 2152 - protein, 16 aa, Mus musculus
HIYWDDDKRYNPSLKS

SEQ ID NO: 2153 - DNA, 39 bp, Mus musculus
agaggggtctactataggtacgacgatgctatggactac

SEQ ID NO: 2154 - protein, 13 aa, Mus musculus
RGVYYRYDDAMDY

SEQ ID NO: 2155 - DNA, 48 bp, Mus musculus; identical to SEQ ID NO: 27

SEQ ID NO: 2156 - protein, 16 aa, Mus musculus
RSSQSIVHSNGNTYLE

SEQ ID NO: 2157 - DNA, 21 bp, Mus musculus
aaagtttccaaccgattttct

SEQ ID NO: 2158 - protein, 7 aa, Mus musculus
KVSNRFS

SEQ ID NO: 2159 - DNA, 27 bp, Mus musculus
tttcaaggttcacatgttccgctcacg

SEQ ID NO: 2160 - protein, 9 aa, Mus musculus
FQGSHVPLT

SEQ ID NO: 2161 - DNA, 411 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaggagggcacgtgggtgctatggactactggggtcaaggaacctcagtcaccgtctcctca

SEQ ID NO: 2162 - protein, 137 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGHVGAMDYWGQGTSVTVSS

SEQ ID NO: 2163 - DNA, 327 bp, Mus musculus; identical to SEQ ID NO: 595

SEQ ID NO: 2164 - protein, 109 aa, Mus musculus; identical to SEQ ID NO: 596

SEQ ID NO: 2165 - DNA, 15 bp, Mus musculus
agctttggaatgcac

SEQ ID NO: 2166 - protein, 5 aa, Mus musculus
SFGMH

SEQ ID NO: 2167 - DNA, 51 bp, Mus musculus; identical to SEQ ID NO: 119

SEQ ID NO: 2168 - protein, 17 aa, Mus musculus
YISSGSSTIYYADTVKG

SEQ ID NO: 2169 - DNA, 27 bp, Mus musculus
ggagggcacgtgggtgctatggactac

SEQ ID NO: 2170 - protein, 9 aa, Mus musculus
GGHVGAMDY

SEQ ID NO: 2171 - DNA, 48 bp, Mus musculus; identical to SEQ ID NO: 43

SEQ ID NO: 2172 - protein, 16 aa, Mus musculus
RSSQSLVHSNGNTYLH

SEQ ID NO: 2173 - DNA, 21 bp, Mus musculus
aaagtttccaaccgattttct

SEQ ID NO: 2174 - protein, 7 aa, Mus musculus
KVSNRFS

SEQ ID NO: 2175 - DNA, 27 bp, Mus musculus
tctcaaagtacacatgttccgtggacg

SEQ ID NO: 2176 - protein, 9 aa, Mus musculus
SQSTHVPWT

SEQ ID NO: 2177 - DNA, 423 bp, Mus musculus
atggacaggcttacttcttcattcctgctgctgattgtccctgcatatgtcttgtcccaagttactctaaaagagtctggccctgggatattgaagcccccacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagcgcaacaactgggacgaagggaactatggactactggggtcaaggaacctcagtcaccgtctcctca

SEQ ID NO: 2178 - protein, 141 aa, Mus musculus
MDRLTSSFLLLIVPAYVLSQVTLKESGPGILKPPQTLSLTCSFSGFSLSTSGMGVGWIRQPSGKGLEWLAHIWWDDDKYYNPSLKSQLTISKDTSRNQVFLKITSVDTADTATYYCARSATTGTKGTMDYWGQGTSVTVSS

SEQ ID NO: 2179 - DNA, 327 bp, Mus musculus; identical to SEQ ID NO: 51

SEQ ID NO: 2180 - protein, 109 aa, Mus musculus; identical to SEQ ID NO: 52

SEQ ID NO: 2181 - DNA, 21 bp, Mus musculus
acttctggtatgggtgtaggc

SEQ ID NO: 2182 - protein, 7 aa, Mus musculus
TSGMGVG

SEQ ID NO: 2183 - DNA, 48 bp, Mus musculus; identical to SEQ ID NO: 103

SEQ ID NO: 2184 - protein, 16 aa, Mus musculus
HIWWDDDKYYNPSLKS

SEQ ID NO: 2185 - DNA, 36 bp, Mus musculus
agcgcaacaactgggacgaagggaactatggactac

SEQ ID NO: 2186 - protein, 12 aa, Mus musculus
SATTGTKGTMDY

SEQ ID NO: 2187 - DNA, 48 bp, Mus musculus; identical to SEQ ID NO: 27

SEQ ID NO: 2188 - protein, 16 aa, Mus musculus
RSSQSIVHSNGNTYLE

SEQ ID NO: 2189 - DNA, 21 bp, Mus musculus
aaagtttccaaccgattttct

SEQ ID NO: 2190 - protein, 7 aa, Mus musculus
KVSNRFS

SEQ ID NO: 2191 - DNA, 27 bp, Mus musculus
tttcaaggttcacatgttccgctcacg

SEQ ID NO: 2192 - protein, 9 aa, Mus musculus
FQGSHVPLT

SEQ ID NO: 2193 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcagtttcagtagctttggaatgcactgggttcgtcaggctccagagaaggggctggagtgggtcgcatacattagtagtggcaggagtaccatctactatgcagacacagtgaagggccgattcaccatctccagagacaatcccaagaacaccctgttcctgcaaatgaccagtctaaggtctgaggacacggccatgtattactgtgcaagattgaggggtaacttggactatgctatggactactggggtcaaggaacctcagtcaccgtctcctca

SEQ ID NO: 2194 - protein, 139 aa, Mus musculus
MDSRLNLVFLVLILKGVQCDVQLVESGGGLVQPGGSRKLSCAASGFSFSSFGMHWVRQAPEKGLEWVAYISSGRSTIYYADTVKGRFTISRDNPKNTLFLQMTSLRSEDTAMYYCARLRGNLDYAMDYWGQGTSVTVSS

SEQ ID NO: 2195 - DNA, 327 bp, Mus musculus; identical to SEQ ID NO: 1331

SEQ ID NO: 2196 - protein, 109 aa, Mus musculus; identical to SEQ ID NO: 1332

SEQ ID NO: 2197 - DNA, 15 bp, Mus musculus
agctttggaatgcac

SEQ ID NO: 2198 - protein, 5 aa, Mus musculus
SFGMH

SEQ ID NO: 2199 - DNA, 51 bp, Mus musculus
tacattagtagtggcaggagtaccatctactatgcagacacagtgaagggc

SEQ ID NO: 2200 - protein, 17 aa, Mus musculus
YISSGRSTIYYADTVKG

SEQ ID NO: 2201 - DNA, 33 bp, Mus musculus
ttgaggggtaacttggactatgctatggactac

SEQ ID NO: 2202 - protein, 11 aa, Mus musculus
LRGNLDYAMDY

SEQ ID NO: 2203 - DNA, 48 bp, Mus musculus; identical to SEQ ID NO: 43

SEQ ID NO: 2204 - protein, 16 aa, Mus musculus
RSSQSLVHSNGNTYLH

SEQ ID NO: 2205 - DNA, 21 bp, Mus musculus
aaagtttccaaccgattttct

SEQ ID NO: 2206 - protein, 7 aa, Mus musculus
KVSNRFS

SEQ ID NO: 2207 - DNA, 27 bp, Mus musculus
tctcaaagtacacatgttccattcacg

SEQ ID NO: 2208 - protein, 9 aa, Mus musculus
SQSTHVPFT

SEQ ID NO: 2209 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattagatggttacaggggtgactactggggccaaggcaccactctcacagtctcctca

SEQ ID NO: 2210 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLDGYRGDYWGQGTTLTVSS

SEQ ID NO: 2211 - DNA, 363 bp, Mus musculus
atgttctggattcctgcttccagcagtgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggctcggggacaaagttggaaataaaa

SEQ ID NO: 2212 - protein, 121 aa, Mus musculus
MFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGSGTKLEIK

SEQ ID NO: 2213 - DNA, 15 bp, Mus musculus
agctttggaatgcac

SEQ ID NO: 2214 - protein, 5 aa, Mus musculus
SFGMH

SEQ ID NO: 2215 - DNA, 51 bp, Mus musculus; identical to SEQ ID NO: 119

SEQ ID NO: 2216 - protein, 17 aa, Mus musculus
YISSGSSTIYYADTVKG

SEQ ID NO: 2217 - DNA, 24 bp, Mus musculus
ttagatggttacaggggtgactac

SEQ ID NO: 2218 - protein, 8 aa, Mus musculus
LDGYRGDY

SEQ ID NO: 2219 - DNA, 48 bp, Mus musculus; identical to SEQ ID NO: 43

SEQ ID NO: 2220 - protein, 16 aa, Mus musculus
RSSQSLVHSNGNTYLH

SEQ ID NO: 2221 - DNA, 21 bp, Mus musculus
aaagtttccaaccgattttct

SEQ ID NO: 2222 - protein, 7 aa, Mus musculus
KVSNRFS

SEQ ID NO: 2223 - DNA, 27 bp, Mus musculus
tctcaaagtacacatgttcctctcacg

SEQ ID NO: 2224 - protein, 9 aa, Mus musculus
SQSTHVPLT

SEQ ID NO: 2225 - DNA, 441 bp, Mus musculus
atgaacttggggctcagcttgattttccttgtccttgttttaaaaggtgtccagtgtgaagtgaagctggtggagtctgggggaggcttagtgcagcctggagggtccctgaaactctcctgtgcaacctctggattcactttcagtgactattacatgtattgggttcgccagactccagagaagaggctggagtgggtcgcatacattagtaatggtggtggtagaacctattatccagacactgtaaagggccgattcaccatctccagagacaatgccaagaacaccctgtacctgcaaatgagccgtctgaagtctgaggacacagccatgtattactgtgccagagggacctcatacggtagtggccttcattactatgctatggactactggggtcaaggaacctcagtcaccgtctcctcagccaaaacaaca

SEQ ID NO: 2226 - protein, 147 aa, Mus musculus
MNLGLSLIFLVLVLKGVQCEVKLVESGGGLVQPGGSLKLSCATSGFTFSDYYMYWVRQTPEKRLEWVAYISNGGGRTYYPDTVKGRFTISRDNAKNTLYLQMSRLKSEDTAMYYCARGTSYGSGLHYYAMDYWGQGTSVTVSSAKTT

SEQ ID NO: 2227 - DNA, 327 bp, Mus musculus; identical to SEQ ID NO: 867

SEQ ID NO: 2228 - protein, 109 aa, Mus musculus; identical to SEQ ID NO: 36

SEQ ID NO: 2229 - DNA, 15 bp, Mus musculus
gactattacatgtat

SEQ ID NO: 2230 - protein, 5 aa, Mus musculus
DYYMY

SEQ ID NO: 2231 - DNA, 51 bp, Mus musculus
tacattagtaatggtggtggtagaacctattatccagacactgtaaagggc

SEQ ID NO: 2232 - protein, 17 aa, Mus musculus
YISNGGGRTYYPDTVKG

SEQ ID NO: 2233 - DNA, 45 bp, Mus musculus; identical to SEQ ID NO: 1849

SEQ ID NO: 2234 - protein, 15 aa, Mus musculus
GTSYGSGLHYYAMDY

SEQ ID NO: 2235 - DNA, 48 bp, Mus musculus; identical to SEQ ID NO: 43

SEQ ID NO: 2236 - protein, 16 aa, Mus musculus
RSSQSLVHSNGNTYLH

SEQ ID NO: 2237 - DNA, 21 bp, Mus musculus
aaagtttccaaccgattttct

SEQ ID NO: 2238 - protein, 7 aa, Mus musculus
KVSNRFS

SEQ ID NO: 2239 - DNA, 27 bp, Mus musculus
tctcaaagtacacatgttccgctcacg

SEQ ID NO: 2240 - protein, 9 aa, Mus musculus
SQSTHVPLT

SEQ ID NO: 2241 - DNA, 408 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactattactatgctatggactactggggtcaaggaacctcagtcaccgtctcctca

SEQ ID NO: 2242 - protein, 136 aa, Mus musculus
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYYYAMDYWGQGTSVTVSS

SEQ ID NO: 2243 - DNA, 327 bp, Mus musculus; identical to SEQ ID NO: 243

SEQ ID NO: 2244 - protein, 109 aa, Mus musculus; identical to SEQ ID NO: 244

SEQ ID NO: 2245 - DNA, 15 bp, Mus musculus
agctttggaatgcac

SEQ ID NO: 2246 - protein, 5 aa, Mus musculus
SFGMH

SEQ ID NO: 2247 - DNA, 51 bp, Mus musculus; identical to SEQ ID NO: 119

SEQ ID NO: 2248 - protein, 17 aa, Mus musculus
YISSGSSTIYYADTVKG

SEQ ID NO: 2249 - DNA, 24 bp, Mus musculus
tactattactatgctatggactac

SEQ ID NO: 2250 - protein, 8 aa, Mus musculus
YYYYAMDY

SEQ ID NO: 2251 - DNA, 48 bp, Mus musculus; identical to SEQ ID NO: 27

SEQ ID NO: 2252 - protein, 16 aa, Mus musculus
RSSQSIVHSNGNTYLE

SEQ ID NO: 2253 - DNA, 21 bp, Mus musculus
aaagtttccaaccgattttct

SEQ ID NO: 2254 - protein, 7 aa, Mus musculus
KVSNRFS

SEQ ID NO: 2255 - DNA, 27 bp, Mus musculus
tttcaaggttcacatgttcctccgacg

SEQ ID NO: 2256 - protein, 9 aa, Mus musculus
FQGSHVPPT

SEQ ID NO: 2257 - DNA, 417 bp, Mus musculus
atggactccaggctcaatttagttttccttgtccttattttaaaaggtgtccagtgtgatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtggtggcagtagtaccatctactatgcagacacagtgaagggccgattcaccatctccagagacaatcccaagaacaccctgttcctgcaaatgaccagtctaaggtctaaggacacggccatgtattactgtgcaagatccccatttctacggctacagggacttgcttactggggccaagggactctggtcactgtctctgca

SEQ ID NO: 2258 - protein, 139 aa, Mus musculus
MDSRLNLVFLVLILKGVQCDVQLVESGGGLVQPGGSRKLSCAASGFTFSSFGMHWVRQAPEKGLEWVAYISGGSSTIYYADTVKGRFTISRDNPKNTLFLQMTSLRSKDTAMYYCARSPFLRLQGLAYWGQGTLVTVSA

SEQ ID NO: 2259 - DNA, 327 bp, Mus musculus; identical to SEQ ID NO: 243

SEQ ID NO: 2260 - protein, 109 aa, Mus musculus; identical to SEQ ID NO: 244

SEQ ID NO: 2261 - DNA, 15 bp, Mus musculus
agctttggaatgcac

SEQ ID NO: 2262 - protein, 5 aa, Mus musculus
SFGMH

SEQ ID NO: 2263 - DNA, 51 bp, Mus musculus
tacattagtggtggcagtagtaccatctactatgcagacacagtgaagggc

SEQ ID NO: 2264 - protein, 17 aa, Mus musculus
YISGGSSTIYYADTVKG

SEQ ID NO: 2265 - DNA, 33 bp, Mus musculus
tccccatttctacggctacagggacttgcttac

SEQ ID NO: 2266 - protein, 11 aa, Mus musculus
SPFLRLQGLAY

SEQ ID NO: 2267 - DNA, 48 bp, Mus musculus; identical to SEQ ID NO: 27

SEQ ID NO: 2268 - protein, 16 aa, Mus musculus
RSSQSIVHSNGNTYLE

SEQ ID NO: 2269 - DNA, 21 bp, Mus musculus
aaagtttccaaccgattttct

SEQ ID NO: 2270 - protein, 7 aa, Mus musculus
KVSNRFS

SEQ ID NO: 2271 - DNA, 27 bp, Mus musculus
tttcaaggttcacatgttcctccgacg

SEQ ID NO: 2272 - protein, 9 aa, Mus musculus
FQGSHVPPT

SEQ ID NO: 2273 - DNA, 420 bp, Mus musculus
atggacaggcttacttcttcattcctgctgctgattgtccctgcatatgtcttgccccaagttactctaaaagagtctggccctgggatattgaagccctcacagaccctcagtctgacttgttctttctctgggttttcactgagcacttctggtatgggtgtaggctggattcgtcagccttccgggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagcttcgagggggactgatgctatggactactggggtcaaggaacctcagtcaccgtctcctca

SEQ ID NO: 2274 - protein, 140 aa, Mus musculus
MDRLTSSFLLLIVPAYVLPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRASRGTDAMDYWGQGTSVTVSS

SEQ ID NO: 2275 - DNA, 327 bp, Mus musculus; identical to SEQ ID NO: 51

SEQ ID NO: 2276 - protein, 109 aa, Mus musculus; identical to SEQ ID NO: 52

SEQ ID NO: 2277 - DNA, 21 bp, Mus musculus
acttctggtatgggtgtaggc

SEQ ID NO: 2278 - protein, 7 aa, Mus musculus
TSGMGVG

SEQ ID NO: 2279 - DNA, 48 bp, Mus musculus; identical to SEQ ID NO: 103

SEQ ID NO: 2280 - protein, 16 aa, Mus musculus
HIWWDDDKYYNPSLKS

SEQ ID NO: 2281 - DNA, 33 bp, Mus musculus
agagcttcgagggggactgatgctatggactac

SEQ ID NO: 2282 - protein, 11 aa, Mus musculus
RASRGTDAMDY

SEQ ID NO: 2283 - DNA, 48 bp, Mus musculus; identical to SEQ ID NO: 27

SEQ ID NO: 2284 - protein, 16 aa, Mus musculus
RSSQSIVHSNGNTYLE

SEQ ID NO: 2285 - DNA, 21 bp, Mus musculus
aaagtttccaaccgattttct

SEQ ID NO: 2286 - protein, 7 aa, Mus musculus
KVSNRFS

SEQ ID NO: 2287 - DNA, 27 bp, Mus musculus
tttcaaggttcacatgttccgctcacg

SEQ ID NO: 2288 - protein, 9 aa, Mus musculus
FQGSHVPLT

SEQ ID NO: 2289 - DNA, 294 bp, Mus musculus; identical to SEQ ID NO: 1

SEQ ID NO: 2290 - protein, 98 aa, Mus musculus; identical to SEQ ID NO: 2

SEQ ID NO: 2291 - DNA, 336 bp, Mus musculus
gacattgtgatgtcacagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatctgtacacgttcggaggggggaccaagctggaaataaaa

SEQ ID NO: 2292 - protein, 112 aa, Mus musculus
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 2293 - DNA, 360 bp, Mus musculus
gaggtgcagctggtggagtctgggggagacttagtgaagcctggagggtccctgaaactctcctgtgcagcctctggattcactttcagtagctatggcatgtcttgggttcgccagactccagacaagaggctggactgggtcgcaaccattagtagtggtggtagttacacctactatccagacagtgtgaaggggcgattcaccatctccagagacaatgccaagaacaccctgtacctgcaaatgagcagtctgaagtctgaggacacagccatgtattactgtgcaagatctactatgattgcgacggggacttttgcttactggggccaagggactctggtcactgtctctgca

SEQ ID NO: 2294 - protein, 120 aa, Mus musculus
EVQLVESGGDLVKPGGSLKLSCAASGFTFSSYGMSWVRQTPDKRLDWVATISSGGSYTYYPDSVKGRFTISRDNAKNTLYLQMSSLKSEDTAMYYCARSTMIATGTFAYWGQGTLVTVSA

SEQ ID NO: 2295 - DNA, 336 bp, Mus musculus
gatgttttgatgacccaaagtccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtggacgttcggtggaggcaccaagctggaaatcaaa

SEQ ID NO: 2296 - protein, 112 aa, Mus musculus
DVLMTQSPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 2297 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgatactacggtagtagcccctttgactactggggccaaggcaccactctcacagtctcctca

SEQ ID NO: 2298 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYYGSSPFDYWGQGTTLTVSS

SEQ ID NO: 2299 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggggtttatttctgctctcaaagtacacatgttccgctcacgttcggtgctgggaccaagctggagctgaaa

SEQ ID NO: 2300 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 2301 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagagtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgattacgacaggggtttgcttactggggccaagggactctggtcactgtctctgca

SEQ ID NO: 2302 - protein, 117 aa, Mus musculus
QVTLKESGPGILQPSQTLSLTCSFSGFSLSTSGMGVSWIRQPSGKSLEWLAHIYWDDDKRYNPSLKSRLTISKDTSRNQVFLKITSVDTADTATYYCARLRQGFAYWGQGTLVTVSA

SEQ ID NO: 2303 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcaaaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 2304 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 2305 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcggtacggtagtagctttgcttactggggccaagggactctggtcactgtctctgca

SEQ ID NO: 2306 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGSSFAYWGQGTLVTVSA

SEQ ID NO: 2307 - DNA, 336 bp, Mus musculus; identical to SEQ ID NO: 2291

SEQ ID NO: 2308 - protein, 112 aa, Mus musculus; identical to SEQ ID NO: 2292

SEQ ID NO: 2309 - DNA, 363 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagggttactacgtcgggatgctatggactactggggtcaaggaacctcagtcaccgtctcctca

SEQ ID NO: 2310 - protein, 121 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLLRRDAMDYWGQGTSVTVSS

SEQ ID NO: 2311 - DNA, 336 bp, Mus musculus; identical to SEQ ID NO: 2303

SEQ ID NO: 2312 - protein, 112 aa, Mus musculus; identical to SEQ ID NO: 2304

SEQ ID NO: 2313 - DNA, 366 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagctctctacggtaaccttgactactttgactactggggccaaggcaccactctcacagtctcctca

SEQ ID NO: 2314 - protein, 122 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYGNLDYFDYWGQGTTLTVSS

SEQ ID NO: 2315 - DNA, 336 bp, Mus musculus; identical to SEQ ID NO: 2291

SEQ ID NO: 2316 - protein, 112 aa, Mus musculus; identical to SEQ ID NO: 2292

SEQ ID NO: 2317 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagcgaggtacgacgaggggctatggactactggggtcaaggaacctcagtcaccgtctcctca

SEQ ID NO: 2318 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSEVRRGAMDYWGQGTSVTVSS

SEQ ID NO: 2319 - DNA, 336 bp, Mus musculus; identical to SEQ ID NO: 2291

SEQ ID NO: 2320 - protein, 112 aa, Mus musculus; identical to SEQ ID NO: 2292

SEQ ID NO: 2321 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagccctttatgattacgactactttgactactggggccaaggcaccactctcacagtctcctca

SEQ ID NO: 2322 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYDYDYFDYWGQGTTLTVSS

SEQ ID NO: 2323 - DNA, 336 bp, Mus musculus; identical to SEQ ID NO: 2291

SEQ ID NO: 2324 - protein, 112 aa, Mus musculus; identical to SEQ ID NO: 2292

SEQ ID NO: 2325 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgagggattacgacgcgttactatactatggactactggggtcaaggaacctcagtcaccgtctcctca

SEQ ID NO: 2326 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARGITTRYYTMDYWGQGTSVTVSS

SEQ ID NO: 2327 - DNA, 336 bp, Mus musculus; identical to SEQ ID NO: 2291

SEQ ID NO: 2328 - protein, 112 aa, Mus musculus; identical to SEQ ID NO: 2292

SEQ ID NO: 2329 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgttcgaagaggactctatgattacgacaggtttgcttactggggccaagggactctggtcactgtctctgca

SEQ ID NO: 2330 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCVRRGLYDYDRFAYWGQGTLVTVSA

SEQ ID NO: 2331 - DNA, 336 bp, Mus musculus
gatgttttgatgacccaaactccactctccctgcctgtcagtcttggagatcaagcctccatctcttgcagatctagtcagggcattgtccatagtactggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 2332 - protein, 112 aa, Mus musculus
DVLMTQTPLSLPVSLGDQASISCRSSQGIVHSTGNTYLEWYLQKPGQSPKLLIYKVSNRFSGVPDRFSGSGSGTDFTLKISRVEAEDLGVYYCFQGSHVPLTFGAGTKLELK

SEQ ID NO: 2333 - DNA, 363 bp, Mus musculus; identical to SEQ ID NO: 2325

SEQ ID NO: 2334 - protein, 121 aa, Mus musculus; identical to SEQ ID NO: 2326

SEQ ID NO: 2335 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttatcactgctttcaaggttcacatgttccgctcacgttcggtgctgggaccaagctggagctgaaa

SEQ ID NO: 2336 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYHCFQGSHVPLTFGAGTKLELK

SEQ ID NO: 2337 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgctacggtagtagctttgcttactggggccaagggactctggtcactgtctctgca

SEQ ID NO: 2338 - protein, 117 aa, Mus musculus; identical to SEQ ID NO: 2306

SEQ ID NO: 2339 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 2340 - protein, 112 aa, Mus musculus; identical to SEQ ID NO: 2304

SEQ ID NO: 2341 - DNA, 369 bp, Mus musculus
caggttactctgaaagagtctggccctgggatattgcagccctcccagacccacagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaaaaggggtctactatgattacgacgtcgggtttgcttactggggccaagggactctggtcactgtctctgca

SEQ ID NO: 2342 - protein, 123 aa, Mus musculus
QVTLKESGPGILQPSQTHSLTCSFSGFSLSTSGMGVSWIRQPSGKGLEWLAHIYWDDDKRYNPSLKSRLTISKDTSRNQVFLKITSVDTADTATYYCARKGVYYDYDVGFAYWGQGTLVTVSA

SEQ ID NO: 2343 - DNA, 336 bp, Mus musculus; identical to SEQ ID NO: 2339

SEQ ID NO: 2344 - protein, 112 aa, Mus musculus; identical to SEQ ID NO: 2304

SEQ ID NO: 2345 - DNA, 366 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagccctttattactacggggattactttgactactggggccaaggcaccactctcacagtctcctca

SEQ ID NO: 2346 - protein, 122 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYYYGDYFDYWGQGTTLTVSS

SEQ ID NO: 2347 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggtgctgggaccaagctggagctgaaa

SEQ ID NO: 2348 - protein, 112 aa, Mus musculus; identical to SEQ ID NO: 2304

SEQ ID NO: 2349 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagggatgattacgacggatgctatggactactggggtcaaggaacctcagtcaccgtctcctca

SEQ ID NO: 2350 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGMITTDAMDYWGQGTSVTVSS

SEQ ID NO: 2351 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctccgacgttcggtggaggcaccaagctggaaatcaaa

SEQ ID NO: 2352 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIK

SEQ ID NO: 2353 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcggtacggtagagggtttgcttactggggccaagggactctggtcactgtctctgca

SEQ ID NO: 2354 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGRGFAYWGQGTLVTVSA

SEQ ID NO: 2355 - DNA, 336 bp, Mus musculus; identical to SEQ ID NO: 2339

SEQ ID NO: 2356 - protein, 112 aa, Mus musculus; identical to SEQ ID NO: 2304

SEQ ID NO: 2357 - DNA, 351 bp, Mus musculus
gaagtgcagctggtggagtctgggggaggcttagtgaagcctggagggtccctgaaactctcctgtgcagcctctggattcactttcagtagctatgccatgtcttgggttcgccagactccggagaagaggctggagtgggtcgcaaccattagtagtggtggtagttacacctactatccagacagtgtgaagggtcgattcaccatctccagagacaatgccaagaacaccctgtacctgcaaatgagcagtctgaggtctgaggacacggccatgtattactgtgcaagacaaaactgggatgggtttgcttactggggccaagggactctggtcactgtctctgca

SEQ ID NO: 2358 - protein, 117 aa, Mus musculus
EVQLVESGGGLVKPGGSLKLSCAASGFTFSSYAMSWVRQTPEKRLEWVATISSGGSYTYYPDSVKGRFTISRDNAKNTLYLQMSSLRSEDTAMYYCARQNWDGFAYWGQGTLVTVSA

SEQ ID NO: 2359 - DNA, 336 bp, Mus musculus
gacattgtgatgtcacagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatcttccgacgttcggtggaggcaccaagctggaaatcaaa

SEQ ID NO: 2360 - protein, 112 aa, Mus musculus
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLPTFGGGTKLEIK

SEQ ID NO: 2361 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtactcgaagagccctctatgattacgacgctatggactactggggtcaaggaacctcagtcaccgtctcctca

SEQ ID NO: 2362 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCTRRALYDYDAMDYWGQGTSVTVSS

SEQ ID NO: 2363 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggtgctgggaccaagctggagctgaaa

SEQ ID NO: 2364 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGAGTKLELK

SEQ ID NO: 2365 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagcctactatggtaaccactttgactactggggccaaggcaccactctcacagtctcctca

SEQ ID NO: 2366 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSAYYGNHFDYWGQGTTLTVSS

SEQ ID NO: 2367 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcggacgttcggtggaggcaccaagctggaaatcaaa

SEQ ID NO: 2368 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 2369 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaaggggttataggtacgacgagggatttgcttactggggccaagggactctggtcactgtctctgca

SEQ ID NO: 2370 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGYRYDEGFAYWGQGTLVTVSA

SEQ ID NO: 2371 - DNA, 336 bp, Mus musculus; identical to SEQ ID NO: 2351

SEQ ID NO: 2372 - protein, 112 aa, Mus musculus; identical to SEQ ID NO: 2352

SEQ ID NO: 2373 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaactgggacgggggctatggactactggggtcaaggaacctcagtcaccgtctcctca

SEQ ID NO: 2374 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARTGTGAMDYWGQGTSVTVSS

SEQ ID NO: 2375 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaa

SEQ ID NO: 2376 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIK

SEQ ID NO: 2377 - DNA, 360 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagggttaaagaaggactactttgactactggggccaaggcaccactctcacagtctcctca

SEQ ID NO: 2378 - protein, 120 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLKKDYFDYWGQGTTLTVSS

SEQ ID NO: 2379 - DNA, 336 bp, Mus musculus; identical to SEQ ID NO: 2303

SEQ ID NO: 2380 - protein, 112 aa, Mus musculus; identical to SEQ ID NO: 2304

SEQ ID NO: 2381 - DNA, 357 bp, Mus musculus; identical to SEQ ID NO: 2365

SEQ ID NO: 2382 - protein, 119 aa, Mus musculus; identical to SEQ ID NO: 2366

SEQ ID NO: 2383 - DNA, 336 bp, Mus musculus; identical to SEQ ID NO: 2367

SEQ ID NO: 2384 - protein, 112 aa, Mus musculus; identical to SEQ ID NO: 2368

SEQ ID NO: 2385 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgtctgtatggtaacattgcttactggggccaagggactctggtcactgtctctgca

SEQ ID NO: 2386 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGNIAYWGQGTLVTVSA

SEQ ID NO: 2387 - DNA, 336 bp, Mus musculus; identical to SEQ ID NO: 2303

SEQ ID NO: 2388 - protein, 112 aa, Mus musculus; identical to SEQ ID NO: 2304

SEQ ID NO: 2389 - DNA, 360 bp, Mus musculus
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgaatagggagaactacggggaacttcgatgtctggggcgcagggaccacggtcaccgtctcctca

SEQ ID NO: 2390 - protein, 120 aa, Mus musculus
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIGRTTGNFDVWGAGTTVTVSS

SEQ ID NO: 2391 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgatcttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaa

SEQ ID NO: 2392 - protein, 112 aa, Mus musculus
DVVMTQTPLSLPVSLGDQASISCRSSQSLVHSNGNTYLHWYLQKPGQSPKLLIYKVSNRSSGVPDRFSGSGSGTDFTLKISRVEAEDLGVYFCSQSTHVPPTFGGGTKLEIK

SEQ ID NO: 2393 - DNA, 345 bp, Mus musculus
caggttcagctgcagcagtctggagctgagctgatgaagcctggggcctcagtgaagatatcctgcaaggctactggctacacattcagtagctactggatagagtgggtaaagcagaggcctggacatggccttgagtggattggagacattttacctggaattggtactactaactacaatgagaagttcaagggcaaggccacattcactgcagatacatcctccaacacagcctacatgcaactcagcagcctgacatctgaggactctgccgtctattactgtgcaagtacgggaccggttgactactggggccaaggcaccactctcagagtctcctca

SEQ ID NO: 2394 - protein, 115 aa, Mus musculus
QVQLQQSGAELMKPGASVKISCKATGYTFSSYWIEWVKQRPGHGLEWIGDILPGIGTTNYNEKFKGKATFTADTSSNTAYMQLSSLTSEDSAVYYCASTGPVDYWGQGTTLRVSS

SEQ ID NO: 2395 - DNA, 336 bp, Mus musculus
gatgttgtgatgacccagactccactcactttgtcggttaccattggacaaccagcctctatctcttgcaagtcaagtcagagcctcttatatagtaatggaaaaacctatttgaattggttattacagaggccaggccagtctccaaagcgcctaatctatctggtgtctaaactggactctggagtccctgacaggttcactggcagtggatcaggaacagattttacactgaaaatcagcagagtggaggctgaggatttgggagtttattactgcgtgcaaggtacacattttccattcatgttcggctcggggacaaagttggaaataaaa

SEQ ID NO: 2396 - protein, 112 aa, Mus musculus
DVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPFMFGSGTKLEIK

SEQ ID NO: 2397 - DNA, 360 bp, Mus musculus; identical to SEQ ID NO: 2389

SEQ ID NO: 2398 - protein, 120 aa, Mus musculus; identical to SEQ ID NO: 2390

SEQ ID NO: 2399 - DNA, 336 bp, Mus musculus; identical to SEQ ID NO: 2375

SEQ ID NO: 2400 - protein, 112 aa, Mus musculus; identical to SEQ ID NO: 2376

SEQ ID NO: 2401 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgatatggtaacgggtttgcttactggggccaagggactctggtcactgtctctgca

SEQ ID NO: 2402 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGNGFAYWGQGTLVTVSA

SEQ ID NO: 2403 - DNA, 336 bp, Mus musculus; identical to SEQ ID NO: 2339

SEQ ID NO: 2404 - protein, 112 aa, Mus musculus; identical to SEQ ID NO: 2304

SEQ ID NO: 2405 - DNA, 372 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctaattactacggctacggaatggatgctatggactactggggtcaaggaacctcagtcaccgtctcctca

SEQ ID NO: 2406 - protein, 124 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRANYYGYGMDAMDYWGQGTSVTVSS

SEQ ID NO: 2407 - DNA, 336 bp, Mus musculus; identical to SEQ ID NO: 2339

SEQ ID NO: 2408 - protein, 112 aa, Mus musculus; identical to SEQ ID NO: 2304

SEQ ID NO: 2409 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgggactatggactactggggtcaaggaacctcagtcaccgtctcctca

SEQ ID NO: 2410 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGTMDYWGQGTSVTVSS

SEQ ID NO: 2411 - DNA, 336 bp, Mus musculus
gatgctgtgatgacccaaactccactctccctgcctgtcagtcttggagatcaagcctccatctcttgcaggtctagtcagagccttgaaaacagtaatggaaacacctatttgaactggtacctccagaaaccaggccagtctccacagctcctgatctacagggtttccaaccgattttctggggtcctagacaggttcagtggtagtggatcagggacagatttcacactgaaaatcagcagagtggaggctgaggatttgggagtttatttctgcctccaagttacacatgtccctccgacgttcggtggaggcaccaagctggaaatcaaa

SEQ ID NO: 2412 - protein, 112 aa, Mus musculus
DAVMTQTPLSLPVSLGDQASISCRSSQSLENSNGNTYLNWYLQKPGQSPQLLIYRVSNRFSGVLDRFSGSGSGTDFTLKISRVEAEDLGVYFCLQVTHVPPTFGGGTKLEIK

SEQ ID NO: 2413 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgagggattacgacggggtttgcttactggggccaagggactctggtcactgtctctgca

SEQ ID NO: 2414 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGITTGFAYWGQGTLVTVSA

SEQ ID NO: 2415 - DNA, 336 bp, Mus musculus; identical to SEQ ID NO: 2339

SEQ ID NO: 2416 - protein, 112 aa, Mus musculus; identical to SEQ ID NO: 2304

SEQ ID NO: 2417 - DNA, 366 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgacgtagacagctcgggctacgtgatgctatggactactggggtcaaggaacctcagtcaccgtctcctca

SEQ ID NO: 2418 - protein, 122 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRQLGLRDAMDYWGQGTSVTVSS

SEQ ID NO: 2419 - DNA, 336 bp, Mus musculus; identical to SEQ ID NO: 2339

SEQ ID NO: 2420 - protein, 112 aa, Mus musculus; identical to SEQ ID NO: 2304

SEQ ID NO: 2421 - DNA, 360 bp, Mus musculus; identical to SEQ ID NO: 2389

SEQ ID NO: 2422 - protein, 120 aa, Mus musculus; identical to SEQ ID NO: 2390

SEQ ID NO: 2423 - DNA, 336 bp, Mus musculus; identical to SEQ ID NO: 2375

SEQ ID NO: 2424 - protein, 112 aa, Mus musculus; identical to SEQ ID NO: 2376

SEQ ID NO: 2425 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagggggtactatgccctctcttactggggccaagggactctggtcactgtctctgca

SEQ ID NO: 2426 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGYYALSYWGQGTLVTVSA

SEQ ID NO: 2427 - DNA, 336 bp, Mus musculus; identical to SEQ ID NO: 2339

SEQ ID NO: 2428 - protein, 112 aa, Mus musculus; identical to SEQ ID NO: 2304

SEQ ID NO: 2429 - DNA, 360 bp, Mus musculus; identical to SEQ ID NO: 2377

SEQ ID NO: 2430 - protein, 120 aa, Mus musculus; identical to SEQ ID NO: 2378

SEQ ID NO: 2431 - DNA, 336 bp, Mus musculus; identical to SEQ ID NO: 2339

SEQ ID NO: 2432 - protein, 112 aa, Mus musculus; identical to SEQ ID NO: 2304

SEQ ID NO: 2433 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagggcttcgagggggactgatgctatggactactggggtcaaggaacctcagtcaccgtctcctca

SEQ ID NO: 2434 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRASRGTDAMDYWGQGTSVTVSS

SEQ ID NO: 2435 - DNA, 336 bp, Mus musculus; identical to SEQ ID NO: 2339

SEQ ID NO: 2436 - protein, 112 aa, Mus musculus; identical to SEQ ID NO: 2304

SEQ ID NO: 2437 - DNA, 357 bp, Mus musculus
gatgtgcagcttcaggagtcaggacctgacctggtgaaaccttctcagtcactttcactcacctgcactgtcactggctactccatcaccagtggttatagctggcactggatccggcagtttccaggaaacaaactggaatggatgggctacatacactacagtggtagcactaactacaacccatctctcaaaagtcgaatctctatcactcgagacacatccaagaaccagttcttcctgcagttgaattctgtgactactgaggacacagccacatattactgtgcaagatacctttattactacggtagtagctacgagtggggccaaggcaccactctcacagtctcctca

SEQ ID NO: 2438 - protein, 119 aa, Mus musculus
DVQLQESGPDLVKPSQSLSLTCTVTGYSITSGYSWHWIRQFPGNKLEWMGYIHYSGSTNYNPSLKSRISITRDTSKNQFFLQLNSVTTEDTATYYCARYLYYYGSSYEWGQGTTLTVSS

SEQ ID NO: 2439 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaa

SEQ ID NO: 2440 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 2441 - DNA, 366 bp, Mus musculus; identical to SEQ ID NO: 2417

SEQ ID NO: 2442 - protein, 122 aa, Mus musculus; identical to SEQ ID NO: 2418

SEQ ID NO: 2443 - DNA, 336 bp, Mus musculus; identical to SEQ ID NO: 2339

SEQ ID NO: 2444 - protein, 112 aa, Mus musculus; identical to SEQ ID NO: 2304

SEQ ID NO: 2445 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaaacctttataggtacgacctctttgactactggggccaaggcaccactctcacagtctcctca

SEQ ID NO: 2446 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRNLYRYDLFDYWGQGTTLTVSS

SEQ ID NO: 2447 - DNA, 336 bp, Mus musculus; identical to SEQ ID NO: 2339

SEQ ID NO: 2448 - protein, 112 aa, Mus musculus; identical to SEQ ID NO: 2304

SEQ ID NO: 2449 - DNA, 360 bp, Mus musculus; identical to SEQ ID NO: 2377

SEQ ID NO: 2450 - protein, 120 aa, Mus musculus; identical to SEQ ID NO: 2378

SEQ ID NO: 2451 - DNA, 336 bp, Mus musculus; identical to SEQ ID NO: 2339

SEQ ID NO: 2452 - protein, 112 aa, Mus musculus; identical to SEQ ID NO: 2304

SEQ ID NO: 2453 - DNA, 357 bp, Mus musculus; identical to SEQ ID NO: 2369

SEQ ID NO: 2454 - protein, 119 aa, Mus musculus; identical to SEQ ID NO: 2370

SEQ ID NO: 2455 - DNA, 336 bp, Mus musculus; identical to SEQ ID NO: 2351

SEQ ID NO: 2456 - protein, 112 aa, Mus musculus; identical to SEQ ID NO: 2352

SEQ ID NO: 2457 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaaacactataacccatccctgaagagtcggctcacaatctccaaggatacctccagcaaccagttattcctcaagatcaccagtgtggacactgcagatactgccacatactactgtgctcgctatgtttacgactcgtttgcttactggggccaagggactctggtcactgtctctgca

SEQ ID NO: 2458 - protein, 118 aa, Mus musculus
QVTLKESGPGILQPSQTLSLTCSFSGFSLSTSGMGVSWIRQPSGKGLEWLAHIYWDDDKHYNPSLKSRLTISKDTSSNQLFLKITSVDTADTATYYCARYVYDSFAYWGQGTLVTVSA

SEQ ID NO: 2459 - DNA, 336 bp, Mus musculus; identical to SEQ ID NO: 2303

SEQ ID NO: 2460 - protein, 112 aa, Mus musculus; identical to SEQ ID NO: 2304

SEQ ID NO: 2461 - DNA, 366 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaacgacagctcgggctagagactactttgactactggggccaaggcaccactctcacagtctcctca

SEQ ID NO: 2462 - protein, 122 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRTTARARDYFDYWGQGTTLTVSS

SEQ ID NO: 2463 - DNA, 336 bp, Mus musculus; identical to SEQ ID NO: 2303

SEQ ID NO: 2464 - protein, 112 aa, Mus musculus; identical to SEQ ID NO: 2304

SEQ ID NO: 2465 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactacggtagaggtggggctatggactactggggtcaaggaacctcagtcaccgtctcctca

SEQ ID NO: 2466 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGRGGAMDYWGQGTSVTVSS

SEQ ID NO: 2467 - DNA, 336 bp, Mus musculus; identical to SEQ ID NO: 2351

SEQ ID NO: 2468 - protein, 112 aa, Mus musculus; identical to SEQ ID NO: 2352

SEQ ID NO: 2469 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggctataggtacttatttgactactggggccaaggcaccactctcacagtctcctca

SEQ ID NO: 2470 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGYRYLFDYWGQGTTLTVSS

SEQ ID NO: 2471 - DNA, 336 bp, Mus musculus; identical to SEQ ID NO: 2439

SEQ ID NO: 2472 - protein, 112 aa, Mus musculus; identical to SEQ ID NO: 2440

SEQ ID NO: 2473 - DNA, 360 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagctctatggtatccctggtttgcttactggggccaagggactctggtcactgtctctgca

SEQ ID NO: 2474 - protein, 120 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRALWYPWFAYWGQGTLVTVSA

SEQ ID NO: 2475 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggctcggggacaaagttggaaataaaa

SEQ ID NO: 2476 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGSGTKLEIK

SEQ ID NO: 2477 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagcacggagctacggtgctatggactactggggtcaaggaacctcagtcaccgtctcctca

SEQ ID NO: 2478 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSARSYGAMDYWGQGTSVTVSS

SEQ ID NO: 2479 - DNA, 336 bp, Mus musculus; identical to SEQ ID NO: 2303

SEQ ID NO: 2480 - protein, 112 aa, Mus musculus; identical to SEQ ID NO: 2304

SEQ ID NO: 2481 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaactatgctatggactactggggtcaaggaacctcagtcaccgtctcctca

SEQ ID NO: 2482 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYAMDYWGQGTSVTVSS

SEQ ID NO: 2483 - DNA, 336 bp, Mus musculus; identical to SEQ ID NO: 2351

SEQ ID NO: 2484 - protein, 112 aa, Mus musculus; identical to SEQ ID NO: 2352

SEQ ID NO: 2485 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagggagggaaatatggactactggggtcaaggaacctcagtcaccgtctcctca

SEQ ID NO: 2486 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGNMDYWGQGTSVTVSS

SEQ ID NO: 2487 - DNA, 336 bp, Mus musculus; identical to SEQ ID NO: 2375

SEQ ID NO: 2488 - protein, 112 aa, Mus musculus; identical to SEQ ID NO: 2376

SEQ ID NO: 2489 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagaagagggtatggttacgactactggggccaaggcaccactctcacagtctcctca

SEQ ID NO: 2490 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRRGYGYDYWGQGTTLTVSS

SEQ ID NO: 2491 - DNA, 336 bp, Mus musculus; identical to SEQ ID NO: 2303

SEQ ID NO: 2492 - protein, 112 aa, Mus musculus; identical to SEQ ID NO: 2304

SEQ ID NO: 2493 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagggggtaactacctacgatactatgctatggactactggggtcaaggaacctcagtcaccgtctcctca

SEQ ID NO: 2494 - protein, 121 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGNYLRYYAMDYWGQGTSVTVSS

SEQ ID NO: 2495 - DNA, 336 bp, Mus musculus; identical to SEQ ID NO: 2347

SEQ ID NO: 2496 - protein, 112 aa, Mus musculus; identical to SEQ ID NO: 2304

SEQ ID NO: 2497 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagcccctactatgattacgggaggatttgcttactggggccaagggactctggtcactgtctctgca

SEQ ID NO: 2498 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAPTMITGGFAYWGQGTLVTVSA

SEQ ID NO: 2499 - DNA, 336 bp, Mus musculus; identical to SEQ ID NO: 2303

SEQ ID NO: 2500 - protein, 112 aa, Mus musculus; identical to SEQ ID NO: 2304

SEQ ID NO: 2501 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatattaccactatgctatggactactggggtcaaggaacctcagtcaccgtctcctca

SEQ ID NO: 2502 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYHYAMDYWGQGTSVTVSS

SEQ ID NO: 2503 - DNA, 336 bp, Mus musculus; identical to SEQ ID NO: 2351

SEQ ID NO: 2504 - protein, 112 aa, Mus musculus; identical to SEQ ID NO: 2352

SEQ ID NO: 2505 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggggactttgactactggggccaaggcaccactctcacagtctcctca

SEQ ID NO: 2506 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGDFDYWGQGTTLTVSS

SEQ ID NO: 2507 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgctcacgttcggtgctgggaccaagctggagctgaaa

SEQ ID NO: 2508 - protein, 112 aa, Mus musculus; identical to SEQ ID NO: 2300

SEQ ID NO: 2509 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctggcgggtttgcttactggggccaagggactctggtcactgtctctgca

SEQ ID NO: 2510 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAGGFAYWGQGTLVTVSA

SEQ ID NO: 2511 - DNA, 336 bp, Mus musculus; identical to SEQ ID NO: 2303

SEQ ID NO: 2512 - protein, 112 aa, Mus musculus; identical to SEQ ID NO: 2304

SEQ ID NO: 2513 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactacggtagtagctatgctatggactactggggtcaaggaacctcagtcaccgtctcctca

SEQ ID NO: 2514 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGSSYAMDYWGQGTSVTVSS

SEQ ID NO: 2515 - DNA, 336 bp, Mus musculus; identical to SEQ ID NO: 2303

SEQ ID NO: 2516 - protein, 112 aa, Mus musculus; identical to SEQ ID NO: 2304

SEQ ID NO: 2517 - DNA, 360 bp, Mus musculus
caggtgcagctgaagcagtcaggacctggcctagtgcagccctcacagagcctgtccatcacctgcacagtctctggtttctcattaactagctatggtgtacactgggttcgccagtctccaggaaagggtctggagtggctgggagtgatatggagtggtggaagcacagactataatgcagctttcatatccagactgagcatcagcaaggacaattccaagagccaagttttctttaaaatgaacagtctgcaagctaatgacacagccatatattactgtgccagaaaagcctactataggtacggctatgctatggactactggggtcaaggaacctcagtcaccgtctcctca

SEQ ID NO: 2518 - protein, 120 aa, Mus musculus
QVQLKQSGPGLVQPSQSLSITCTVSGFSLTSYGVHWVRQSPGKGLEWLGVIWSGGSTDYNAAFISRLSISKDNSKSQVFFKMNSLQANDTAIYYCARKAYYRYGYAMDYWGQGTSVTVSS

SEQ ID NO: 2519 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcaaaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggtgctgggaccaagctggagctgaaa

SEQ ID NO: 2520 - protein, 112 aa, Mus musculus; identical to SEQ ID NO: 2304

SEQ ID NO: 2521 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggaggtaactaccttatggactactggggtcaaggaacctcagtcaccgtctcctca

SEQ ID NO: 2522 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGNYLMDYWGQGTSVTVSS

SEQ ID NO: 2523 - DNA, 336 bp, Mus musculus; identical to SEQ ID NO: 2303

SEQ ID NO: 2524 - protein, 112 aa, Mus musculus; identical to SEQ ID NO: 2304

SEQ ID NO: 2525 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatctgggactacggctacgattgactactggggccaaggcaccactctcacagtctcctca

SEQ ID NO: 2526 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTTATIDYWGQGTTLTVSS

SEQ ID NO: 2527 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggctcggggacaaagttggaaataaaa

SEQ ID NO: 2528 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGSGTKLEIK

SEQ ID NO: 2529 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaaggcattggaactatgctatggactactggggtcaaggaacctcagtcaccgtctcctca

SEQ ID NO: 2530 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRHWNYAMDYWGQGTSVTVSS

SEQ ID NO: 2531 - DNA, 336 bp, Mus musculus; identical to SEQ ID NO: 2303

SEQ ID NO: 2532 - protein, 112 aa, Mus musculus; identical to SEQ ID NO: 2304

SEQ ID NO: 2533 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgagactacggctacgtttgcttactggggccaagggactctggtcactgtctctgca

SEQ ID NO: 2534 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDETTATFAYWGQGTLVTVSA

SEQ ID NO: 2535 - DNA, 336 bp, Mus musculus; identical to SEQ ID NO: 2375

SEQ ID NO: 2536 - protein, 112 aa, Mus musculus; identical to SEQ ID NO: 2376

SEQ ID NO: 2537 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgtagacacagtgaagggccgattcaccatctccagagacaatcccaagaacaccctgttcctgcaaatgaccagtctaaggtctgaggacacggccatgtattactgtgcaacagtatggtccggtgctatggactactggggtcaaggaacctcagtcaccgtctcctca

SEQ ID NO: 2538 - protein, 117 aa, Mus musculus
DVQLVESGGGLVQPGGSRKLSCAASGFTFSSFGMHWVRQAPEKGLEWVAYISSGSSTIYYVDTVKGRFTISRDNPKNTLFLQMTSLRSEDTAMYYCATVWSGAMDYWGQGTSVTVSS

SEQ ID NO: 2539 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctccgacgttcggtggaggcaccaaggtggaaatcaaa

SEQ ID NO: 2540 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKVEIK

SEQ ID NO: 2541 - DNA, 369 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagccttattactacggtaccctaatgctatggactactggggtcaaggaacctcagtcaccgtctcctca

SEQ ID NO: 2542 - protein, 123 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRALLLRYPNAMDYWGQGTSVTVSS

SEQ ID NO: 2543 - DNA, 336 bp, Mus musculus; identical to SEQ ID NO: 2303

SEQ ID NO: 2544 - protein, 112 aa, Mus musculus; identical to SEQ ID NO: 2304

SEQ ID NO: 2545 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggttactacctctactatgctatggactactggggtcaaggaacctcagtcaccgtctcctca

SEQ ID NO: 2546 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYLYYAMDYWGQGTSVTVSS

SEQ ID NO: 2547 - DNA, 336 bp, Mus musculus; identical to SEQ ID NO: 2303

SEQ ID NO: 2548 - protein, 112 aa, Mus musculus; identical to SEQ ID NO: 2304

SEQ ID NO: 2549 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctccattactacggctggggtacttcgatgtctggggcgcagggaccacggtcaccgtctcctca

SEQ ID NO: 2550 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCAPLLRLGYFDVWGAGTTVTVSS

SEQ ID NO: 2551 - DNA, 336 bp, Mus musculus; identical to SEQ ID NO: 2507

SEQ ID NO: 2552 - protein, 112 aa, Mus musculus; identical to SEQ ID NO: 2300

SEQ ID NO: 2553 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattgggaactgggacgggggctatggactactggggtcaaggaacctcagtcaccgtctcctca

SEQ ID NO: 2554 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGTGTGAMDYWGQGTSVTVSS

SEQ ID NO: 2555 - DNA, 336 bp, Mus musculus; identical to SEQ ID NO: 2439

SEQ ID NO: 2556 - protein, 112 aa, Mus musculus; identical to SEQ ID NO: 2440

SEQ ID NO: 2557 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagacgggggatatacggctactatgctatggactactggggtcaaggaacctcagtcaccgtctcctca

SEQ ID NO: 2558 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGIYGYYAMDYWGQGTSVTVSS

SEQ ID NO: 2559 - DNA, 336 bp, Mus musculus; identical to SEQ ID NO: 2303

SEQ ID NO: 2560 - protein, 112 aa, Mus musculus; identical to SEQ ID NO: 2304

SEQ ID NO: 2561 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggctataggtacagttactatgctatggactactggggtcaaggaacctcagtcaccgtctcctca

SEQ ID NO: 2562 - protein, 121 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGYRYSYYAMDYWGQGTSVTVSS

SEQ ID NO: 2563 - DNA, 336 bp, Mus musculus; identical to SEQ ID NO: 2303

SEQ ID NO: 2564 - protein, 112 aa, Mus musculus; identical to SEQ ID NO: 2304

SEQ ID NO: 2565 - DNA, 354 bp, Mus musculus
caggtccagcttcagcagtctggggctgaactggcaaaacctggggcctcagtgaagatgtcctgcaaggcttctggctacacctttactagctactggatgcactgggtaaaacagaggcctggacagggtctggaatggattggatacattaatcctagcactggttatactgagtacaatcagaagttcaaggacaaggccacattgactgcagacaaatcctccagcacagcctacatgcaactgagcagcctgacatctgaggactctgcagtctattactgtgcaagatgggacggtaggggctactttgactactggggccaaggcaccactctcacagtctcctca

SEQ ID NO: 2566 - protein, 118 aa, Mus musculus
QVQLQQSGAELAKPGASVKMSCKASGYTFTSYWMHWVKQRPGQGLEWIGYINPSTGYTEYNQKFKDKATLTADKSSSTAYMQLSSLTSEDSAVYYCARWDGRGYFDYWGQGTTLTVSS

SEQ ID NO: 2567 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggtgctgggaccaagctggagctgaaa

SEQ ID NO: 2568 - protein, 112 aa, Mus musculus; identical to SEQ ID NO: 2300

SEQ ID NO: 2569 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaccctatattactatgctatggactactggggtcaaggaacctcagtcaccgtctcctca

SEQ ID NO: 2570 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGTLYYYAMDYWGQGTSVTVSS

SEQ ID NO: 2571 - DNA, 336 bp, Mus musculus; identical to SEQ ID NO: 2351

SEQ ID NO: 2572 - protein, 112 aa, Mus musculus; identical to SEQ ID NO: 2352

SEQ ID NO: 2573 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgagggatgattacgacggcgtttgcttactggggccaagggactctggtcactgtctctgca

SEQ ID NO: 2574 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGMITTAFAYWGQGTLVTVSA

SEQ ID NO: 2575 - DNA, 336 bp, Mus musculus; identical to SEQ ID NO: 2303

SEQ ID NO: 2576 - protein, 112 aa, Mus musculus; identical to SEQ ID NO: 2304

SEQ ID NO: 2577 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagacgctggggggagggtgctatggactactggggtcaaggaacctcagtcaccgtctcctca

SEQ ID NO: 2578 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRWGEGAMDYWGQGTSVTVSS

SEQ ID NO: 2579 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacacgttcctccgacgttcggtggaggcaccaagctggaaatcaaa

SEQ ID NO: 2580 - protein, 112 aa, Mus musculus; identical to SEQ ID NO: 2352

SEQ ID NO: 2581 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgaaccttttagactactggggccaaggcaccactctcacagtctcctca

SEQ ID NO: 2582 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNLLDYWGQGTTLTVSS

SEQ ID NO: 2583 - DNA, 336 bp, Mus musculus
gatgctgtgatgacccaaactccactctccctgcctgtcagtcttggagatcaagcctccatctcttgcaggtctagtcagagccttgaaaacagtaatggaaacacctatttgaactggtacctccagaaaccaggccagtctccacagctcctgatctacagggtttccaaccgattttctggggtcctagacaggttcagtggtagtggatcagggacagatttcacactgaaaatcagcagagtggaggctgaggatttgggagtttatttctgcctccaagttacacatgtccctcccacgttcggaggggggaccaagctggaaataaaa

SEQ ID NO: 2584 - protein, 112 aa, Mus musculus; identical to SEQ ID NO: 2412

SEQ ID NO: 2585 - DNA, 354 bp, Mus musculus
gatgtgcagctggtggagtctgggggaggcttagtgcagcctggagggtcccggaaactctcctgtgcagcctctggattcactttcagtaggtttggaatgtactgggttcgtcaggctccagagaaggggctggagtgggtcgcatacattagtagtggcagtagtaccatctactatgcagacatagtgaagggccgattcaccatctccagagacaatcccaagaacaccctgttcctgcaaatgaccagtctaaggtctgaggacacggccatgtattactgtgcaagaagaggttactacgaagctatggactactggggtcaaggaacctcagtcaccgtctcctca

SEQ ID NO: 2586 - protein, 118 aa, Mus musculus
DVQLVESGGGLVQPGGSRKLSCAASGFTFSRFGMYWVRQAPEKGLEWVAYISSGSSTIYYADIVKGRFTISRDNPKNTLFLQMTSLRSEDTAMYYCARRGYYEAMDYWGQGTSVTVSS

SEQ ID NO: 2587 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgatgatctgggagtttattactgctttcaaggttcacatgttcctccgacgttcggtggaggcaccaagctggaaatcaaa

SEQ ID NO: 2588 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEADDLGVYYCFQGSHVPPTFGGGTKLEIK

SEQ ID NO: 2589 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatttattaccacgaggggtgctatggactactggggtcaaggaacctcagtcaccgtctcctca

SEQ ID NO: 2590 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARFITTRGAMDYWGQGTSVTVSS

SEQ ID NO: 2591 - DNA, 336 bp, Mus musculus; identical to SEQ ID NO: 2339

SEQ ID NO: 2592 - protein, 112 aa, Mus musculus; identical to SEQ ID NO: 2304

SEQ ID NO: 2593 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccttctactatgcagacacagtgaagggccgattcaccatctccagagacaatcccaagaacaccctgttcctgcaaatgaccagtctaaggtctgaggacacggccatgtattactgtgcaagagacgggtatggtcgagggggctatgctatggactactggggtcaaggaacctcagtcaccgtctcctca

SEQ ID NO: 2594 - protein, 121 aa, Mus musculus
DVQLVESGGGLVQPGGSRKLSCAASGFTFSSFGMHWVRQAPEKGLEWVAYISSGSSTFYYADTVKGRFTISRDNPKNTLFLQMTSLRSEDTAMYYCARDGYGRGGYAMDYWGQGTSVTVSS

SEQ ID NO: 2595 - DNA, 336 bp, Mus musculus
gatgttttgatgacccaaactccattttccctgcctgtcagtcttggagatcaagcctccatttcttgcagatctagtcagagcattgtacatagtaatggaaacacctatttagaatggtacctgcagaaaccaggccagtctccaaagcccctgatctacaaagtttccaaccgattttctggggtcccagacaggttcagtggcagtggatcagggacagatttcacactcaagatcagcagagtggaggctgaggatctgggagtttattactgctttcaaggttcacatgttcctctcacgttcggtgctgggaccaagctggagctgaaa

SEQ ID NO: 2596 - protein, 112 aa, Mus musculus
DVLMTQTPFSLPVSLGDQASISCRSSQSIVHSNGNTYLEWYLQKPGQSPKPLIYKVSNRFSGVPDRFSGSGSGTDFTLKISRVEAEDLGVYYCFQGSHVPLTFGAGTKLELK

SEQ ID NO: 2597 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagaggttactacgaagctatggactactggggtcaaggaacctcagtcaccgtctcctca

SEQ ID NO: 2598 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGYYEAMDYWGQGTSVTVSS

SEQ ID NO: 2599 - DNA, 336 bp, Mus musculus; identical to SEQ ID NO: 2351

SEQ ID NO: 2600 - protein, 112 aa, Mus musculus; identical to SEQ ID NO: 2352

SEQ ID NO: 2601 - DNA, 354 bp, Mus musculus
caggttactctgaaagagtctggccctgggatattgcagccctcccagaccctcagtctgacttgttctttctctgggttttcactgagcacttctggtatgagtgtaggctggattcgtcagccttcagggaagggtctggagtggctggcacacatttggtgggatgatgacaagcgctataacccagccctgaagagccgactgacaatctccaaggatacctccagcaaccaggtattcctcaagatcgccagtgtggacactgcagatactgccacatactactgtgctcgttacagctctcgtgctatggactactggggtcaaggaacctcagtcaccgtctcctca

SEQ ID NO: 2602 - protein, 118 aa, Mus musculus
QVTLKESGPGILQPSQTLSLTCSFSGFSLSTSGMSVGWIRQPSGKGLEWLAHIWWDDDKRYNPALKSRLTISKDTSSNQVFLKIASVDTADTATYYCARYSSRAMDYWGQGTSVTVSS

SEQ ID NO: 2603 - DNA, 336 bp, Mus musculus; identical to SEQ ID NO: 2339

SEQ ID NO: 2604 - protein, 112 aa, Mus musculus; identical to SEQ ID NO: 2304

SEQ ID NO: 2605 - DNA, 357 bp, Mus musculus
gaggttcagctgcagcagtctggggcagagcttgtgaagccaggggcctcagtcaagttgtcctgcacagcttctggcttcaacattaaagacacctatattcactgggtgaagcagaggcctgaacagggcctggagtggattggaaggattgatcctgcgaatggtaatactaaatatgacccgaagttccagggcaaggccactataacagcagacacatcctccatcacagcctgcctgcagctcagcagcctgacatctgaggacactgccgtctattactgtgctagaaggatctacggtagtggcctttttgcttactggggccaagggactctggtcactgtctctgca

SEQ ID NO: 2606 - protein, 119 aa, Mus musculus
EVQLQQSGAELVKPGASVKLSCTASGFNIKDTYIHWVKQRPEQGLEWIGRIDPANGNTKYDPKFQGKATITADTSSITACLQLSSLTSEDTAVYYCARRIYGSGLFAYWGQGTLVTVSA

SEQ ID NO: 2607 - DNA, 339 bp, Mus musculus
gacattgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagctggagctgaaa

SEQ ID NO: 2608 - protein, 113 aa, Mus musculus
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 2609 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcgggaactgggacgggggctatggactactggggtcaaggaacctcagtcaccgtctcctca

SEQ ID NO: 2610 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTGTGAMDYWGQGTSVTVSS

SEQ ID NO: 2611 - DNA, 336 bp, Mus musculus; identical to SEQ ID NO: 2439

SEQ ID NO: 2612 - protein, 112 aa, Mus musculus; identical to SEQ ID NO: 2440

SEQ ID NO: 2613 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatcagggggctaccgttattactatgctatggactactggggtcaaggaacctcagtcaccgtctcctca

SEQ ID NO: 2614 - protein, 121 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGYRYYYAMDYWGQGTSVTVSS

SEQ ID NO: 2615 - DNA, 336 bp, Mus musculus; identical to SEQ ID NO: 2303

SEQ ID NO: 2616 - protein, 112 aa, Mus musculus; identical to SEQ ID NO: 2304

SEQ ID NO: 2617 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgatctcgctatggtaattttgcttactggggccaagggactctggtcactgtctctgca

SEQ ID NO: 2618 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARSRYGNFAYWGQGTLVTVSA

SEQ ID NO: 2619 - DNA, 336 bp, Mus musculus; identical to SEQ ID NO: 2303

SEQ ID NO: 2620 - protein, 112 aa, Mus musculus; identical to SEQ ID NO: 2304

SEQ ID NO: 2621 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattggggctcaaactgggaaaccttgactactggggccaaggcaccactctcacagtctcctca

SEQ ID NO: 2622 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGLKLGNLDYWGQGTTLTVSS

SEQ ID NO: 2623 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccattcacgttcggctcggggacaaagttggaaataaaa

SEQ ID NO: 2624 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK

SEQ ID NO: 2625 - DNA, 372 bp, Mus musculus
gaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccaggcggggcccctctggttacgaccgggcctggtttgcttactggggccaagggactctggtcactgtctctgca

SEQ ID NO: 2626 - protein, 124 aa, Mus musculus
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRRGPSGYDRAWFAYWGQGTLVTVSA

SEQ ID NO: 2627 - DNA, 339 bp, Mus musculus
gacattgtgatgtcacagtctccatcctccctagctgtgtcagttggagagaaggttactatgagctgcaagtccagtcagagccttttatatagtagcaatcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtggacgttcggtggaggcaccaagctggaaatcaaa

SEQ ID NO: 2628 - protein, 113 aa, Mus musculus
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIK

SEQ ID NO: 2629 - DNA, 372 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctccccgtctttactacggctacgatgctatggactactggggtcaaggaacctcagtcaccgtctcctca

SEQ ID NO: 2630 - protein, 124 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAPRLYYGYDAMDYWGQGTSVTVSS

SEQ ID NO: 2631 - DNA, 336 bp, Mus musculus; identical to SEQ ID NO: 2303

SEQ ID NO: 2632 - protein, 112 aa, Mus musculus; identical to SEQ ID NO: 2304

SEQ ID NO: 2633 - DNA, 363 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagaggactacggctacgggacgctatggactactggggtcaaggaacctcagtcaccgtctcctca

SEQ ID NO: 2634 - protein, 121 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLRLRDAMDYWGQGTSVTVSS

SEQ ID NO: 2635 - DNA, 336 bp, Mus musculus; identical to SEQ ID NO: 2303

SEQ ID NO: 2636 - protein, 112 aa, Mus musculus; identical to SEQ ID NO: 2304

SEQ ID NO: 2637 - DNA, 354 bp, Mus musculus; identical to SEQ ID NO: 2617

SEQ ID NO: 2638 - protein, 118 aa, Mus musculus; identical to SEQ ID NO: 2618

SEQ ID NO: 2639 - DNA, 336 bp, Mus musculus; identical to SEQ ID NO: 2303

SEQ ID NO: 2640 - protein, 112 aa, Mus musculus; identical to SEQ ID NO: 2304

SEQ ID NO: 2641 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagctacggtagtagctacggggggacctttgactactggggccaaggcaccactctcacagtctcctca

SEQ ID NO: 2642 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGSSYGGTFDYWGQGTTLTVSS

SEQ ID NO: 2643 - DNA, 336 bp, Mus musculus; identical to SEQ ID NO: 2507

SEQ ID NO: 2644 - protein, 112 aa, Mus musculus; identical to SEQ ID NO: 2300

SEQ ID NO: 2645 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctacggtctgaggacacggccatgtattactgtgcaagatcggaactccttgcttattggggccaagggactctggtcactgtctctgca

SEQ ID NO: 2646 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSELLAYWGQGTLVTVSA

SEQ ID NO: 2647 - DNA, 336 bp, Mus musculus
gatactgtgatgacccaaactccactctccctgcctgtcagtcttggagatcaagcctccatctcttgcaggtctagtcagagccttgaaaacagtaatggaaacacctatttgaactggtacctccagaaaccaggccagtctccacagctcctgatctacagggtttccaaccgattttctggggtcctagacaggttcagtggtagtggatcagggacagatttcacactgaaaatcagcagagtggaggctgaggatttgggagtttatttctgcctccaagttacacatgtccctcccacgttcggaggggggaccaagctggaaataaaa

SEQ ID NO: 2648 - protein, 112 aa, Mus musculus
DTVMTQTPLSLPVSLGDQASISCRSSQSLENSNGNTYLNWYLQKPGQSPQLLIYRVSNRFSGVLDRFSGSGSGTDFTLKISRVEAEDLGVYFCLQVTHVPPTFGGGTKLEIK

SEQ ID NO: 2649 - DNA, 363 bp, Mus musculus; identical to SEQ ID NO: 2633

SEQ ID NO: 2650 - protein, 121 aa, Mus musculus; identical to SEQ ID NO: 2634

SEQ ID NO: 2651 - DNA, 336 bp, Mus musculus; identical to SEQ ID NO: 2303

SEQ ID NO: 2652 - protein, 112 aa, Mus musculus; identical to SEQ ID NO: 2304

SEQ ID NO: 2653 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctagaactgggttggactactggggtcaaggaacctcagtcaccgtctcctca

SEQ ID NO: 2654 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRARTGLDYWGQGTSVTVSS

SEQ ID NO: 2655 - DNA, 336 bp, Mus musculus; identical to SEQ ID NO: 2303

SEQ ID NO: 2656 - protein, 112 aa, Mus musculus; identical to SEQ ID NO: 2304

SEQ ID NO: 2657 - DNA, 339 bp, Mus musculus
caggtccaactgcagcagcctggggctgaactggtgaagcctggggcttcagtgaagctgtcctgcaaggcttctggctacaccttcaccagctactggatgcactgggtgaagcagaggcctggacaaggcctcgagtggattggagagattaatcctagcaacggtcgtactaactacaatgagaagttcaagagcaaggccacactgactgtagacaaatcctccagcacagcctacatgcaactcagcagcctgacatctgaggactctgcggtctattactgtgcaagatacgatgcttactggggccaagggactctggtcactgtctctgca

SEQ ID NO: 2658 - protein, 113 aa, Mus musculus
QVQLQQPGAELVKPGASVKLSCKASGYTFTSYWMHWVKQRPGQGLEWIGEINPSNGRTNYNEKFKSKATLTVDKSSSTAYMQLSSLTSEDSAVYYCARYDAYWGQGTLVTVSA

SEQ ID NO: 2659 - DNA, 336 bp, Mus musculus; identical to SEQ ID NO: 2347

SEQ ID NO: 2660 - protein, 112 aa, Mus musculus; identical to SEQ ID NO: 2304

SEQ ID NO: 2661 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagtccccgcggtacctcgtttgcttactggggccaagggactctggtcactgtctctgca

SEQ ID NO: 2662 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARSPRGTSFAYWGQGTLVTVSA

SEQ ID NO: 2663 - DNA, 336 bp, Mus musculus; identical to SEQ ID NO: 2303

SEQ ID NO: 2664 - protein, 112 aa, Mus musculus; identical to SEQ ID NO: 2304

SEQ ID NO: 2665 - DNA, 348 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatacgggtatgctatggactactggggtcaaggaacctcagtcaccgtctcctca

SEQ ID NO: 2666 - protein, 116 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYAMDYWGQGTSVTVSS

SEQ ID NO: 2667 - DNA, 336 bp, Mus musculus; identical to SEQ ID NO: 2351

SEQ ID NO: 2668 - protein, 112 aa, Mus musculus; identical to SEQ ID NO: 2352

SEQ ID NO: 2669 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagaggattacgacgaggggactactttgactactggggccaaggcaccactctcacagtctcctca

SEQ ID NO: 2670 - protein, 121 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGLRRGDYFDYWGQGTTLTVSS

SEQ ID NO: 2671 - DNA, 336 bp, Mus musculus; identical to SEQ ID NO: 2303

SEQ ID NO: 2672 - protein, 112 aa, Mus musculus; identical to SEQ ID NO: 2304

SEQ ID NO: 2673 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcggtattactatgctatggactactggggtcaaggaacctcagtcaccgtctcctca

SEQ ID NO: 2674 - protein, 117 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYYYAMDYWGQGTSVTVSS

SEQ ID NO: 2675 - DNA, 336 bp, Mus musculus; identical to SEQ ID NO: 2303

SEQ ID NO: 2676 - protein, 112 aa, Mus musculus; identical to SEQ ID NO: 2304

SEQ ID NO: 2677 - DNA, 348 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagttatggtaactacggggcttactggggccaagggactctggtcactgtctctgca

SEQ ID NO: 2678 - protein, 116 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGNYGAYWGQGTLVTVSA

SEQ ID NO: 2679 - DNA, 336 bp, Mus musculus; identical to SEQ ID NO: 2351

SEQ ID NO: 2680 - protein, 112 aa, Mus musculus; identical to SEQ ID NO: 2352

SEQ ID NO: 2681 - DNA, 366 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaaggagcatgattacgacgaatgactactttgactactggggccaaggcaccactctcacagtctcctca

SEQ ID NO: 2682 - protein, 122 aa, Mus musculus
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRSMITTNDYFDYWGQGTTLTVSS

SEQ ID NO: 2683 - DNA, 336 bp, Mus musculus; identical to SEQ ID NO: 2351

SEQ ID NO: 2684 - protein, 112 aa, Mus musculus; identical to SEQ ID NO: 2352

SEQ ID NO: 2685 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatgggtactatgctatggactactggggtcaaggaacctcagtcaccgtctcctca

SEQ ID NO: 2686 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYAMDYWGQGTSVTVSS

SEQ ID NO: 2687 - DNA, 336 bp, Mus musculus; identical to SEQ ID NO: 2351

SEQ ID NO: 2688 - protein, 112 aa, Mus musculus; identical to SEQ ID NO: 2352

SEQ ID NO: 2689 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtacaagatccgactatggtaactcctttgcttactggggccaagggactctggtcactgtctctgca

SEQ ID NO: 2690 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCTRSDYGNSFAYWGQGTLVTVSA

SEQ ID NO: 2691 - DNA, 336 bp, Mus musculus; identical to SEQ ID NO: 2507

SEQ ID NO: 2692 - protein, 112 aa, Mus musculus; identical to SEQ ID NO: 2300

SEQ ID NO: 2693 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgcctctggtacgacggcggtcctgcttactggggccaagggactctggtcactgtctctgca

SEQ ID NO: 2694 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARLWYDGGPAYWGQGTLVTVSA

SEQ ID NO: 2695 - DNA, 336 bp, Mus musculus; identical to SEQ ID NO: 2507

SEQ ID NO: 2696 - protein, 112 aa, Mus musculus; identical to SEQ ID NO: 2300

SEQ ID NO: 2697 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgatatggttacgacgctatggactactggggtcaaggaacctcagtcaccgtctcctca

SEQ ID NO: 2698 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYGYDAMDYWGQGTSVTVSS

SEQ ID NO: 2699 - DNA, 336 bp, Mus musculus; identical to SEQ ID NO: 2507

SEQ ID NO: 2700 - protein, 112 aa, Mus musculus; identical to SEQ ID NO: 2300

SEQ ID NO: 2701 - DNA, 354 bp, Mus musculus
caggtgcagctgaaggagtcaggacctggcctggtggcgccctcacagagcctgtccatcacatgcaccatctcagggttctcattaaccagctatggtgtacactgggttcgccagcctccaggaaagggtctggagtggctggtagtgatatggagtgatggaagcacaacctataattcagctctcaaatccagactgagcatcagcaaggacaactccaagagccaacttttcttaaaaatgaacagtctccaaactgatgacacagccatgtactactgtgccagacatagctataggtacggtcttatggactactggggtcaaggaacctcagtcaccgtctcctca

SEQ ID NO: 2702 - protein, 118 aa, Mus musculus
QVQLKESGPGLVAPSQSLSITCTISGFSLTSYGVHWVRQPPGKGLEWLVVIWSDGSTTYNSALKSRLSISKDNSKSQLFLKMNSLQTDDTAMYYCARHSYRYGLMDYWGQGTSVTVSS

SEQ ID NO: 2703 - DNA, 336 bp, Mus musculus; identical to SEQ ID NO: 2567

SEQ ID NO: 2704 - protein, 112 aa, Mus musculus; identical to SEQ ID NO: 2300

SEQ ID NO: 2705 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattattgtgcaatcccaaggactgggacgggggctatggactactggggtcaaggaacctcagtcaccgtctcctca

SEQ ID NO: 2706 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIPRTGTGAMDYWGQGTSVTVSS

SEQ ID NO: 2707 - DNA, 336 bp, Mus musculus; identical to SEQ ID NO: 2507

SEQ ID NO: 2708 - protein, 112 aa, Mus musculus; identical to SEQ ID NO: 2300

SEQ ID NO: 2709 - DNA, 372 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggattatgacaagcgctataacccatccctgaagagccggctcacaatctccaaggatacctccaacaaccaggtattcctcaagatcaccagtgtggacactgcagatactgccacatactactgtgctcgaagaaaggtaactgggacgttggggctcgatgctatggactactggggtcaaggaacctcagtcaccgtctcctca

SEQ ID NO: 2710 - protein, 124 aa, Mus musculus
QVTLKESGPGILQPSQTLSLTCSFSGFSLSTSGMGVSWIRQPSGKGLEWLAHIYWDYDKRYNPSLKSRLTISKDTSNNQVFLKITSVDTADTATYYCARRKVTGTLGLDAMDYWGQGTSVTVSS

SEQ ID NO: 2711 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaatcaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacttgttcctcccacgttcggtgctgggaccaagctggagctgaaa

SEQ ID NO: 2712 - protein, 112 aa, Mus musculus
DVLMTQTPLSLPVSLGDQASISCRSSQSIVHSNGNTYLEWYLQKSGQSPKLLIYKVSNRFSGVPDRFSGSGSGTDFTLKISRVEAEDLGVYYCFQGSLVPPTFGAGTKLELK

SEQ ID NO: 2713 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaacctatgggatctatgctatggactactggggtcaaggaacctcagtcaccgtctcctca

SEQ ID NO: 2714 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCATYGIYAMDYWGQGTSVTVSS

SEQ ID NO: 2715 - DNA, 336 bp, Mus musculus; identical to SEQ ID NO: 2351

SEQ ID NO: 2716 - protein, 112 aa, Mus musculus; identical to SEQ ID NO: 2352

SEQ ID NO: 2717 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatggtaactacggttactatgctatggactactggggtcaaggaacctcagtcaccgtctcctca

SEQ ID NO: 2718 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYGYYAMDYWGQGTSVTVSS

SEQ ID NO: 2719 - DNA, 336 bp, Mus musculus; identical to SEQ ID NO: 2303

SEQ ID NO: 2720 - protein, 112 aa, Mus musculus; identical to SEQ ID NO: 2304

SEQ ID NO: 2721 - DNA, 348 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagtagggggtacttcgatgtctggggcgcagggaccacggtcaccgtctcctca

SEQ ID NO: 2722 - protein, 116 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSRGYFDVWGAGTTVTVSS

SEQ ID NO: 2723 - DNA, 336 bp, Mus musculus; identical to SEQ ID NO: 2351

SEQ ID NO: 2724 - protein, 112 aa, Mus musculus; identical to SEQ ID NO: 2352

SEQ ID NO: 2725 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaatttattactacggtagtagctactactggggccaaggcaccactctcacagtctcctca

SEQ ID NO: 2726 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIYYYGSSYYWGQGTTLTVSS

SEQ ID NO: 2727 - DNA, 336 bp, Mus musculus; identical to SEQ ID NO: 2363

SEQ ID NO: 2728 - protein, 112 aa, Mus musculus; identical to SEQ ID NO: 2364

SEQ ID NO: 2729 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagccggtggttactccctttcctatgctatggactactggggtcaaggaacctcagtcaccgtctcctca

SEQ ID NO: 2730 - protein, 121 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAGGYSLSYAMDYWGQGTSVTVSS

SEQ ID NO: 2731 - DNA, 336 bp, Mus musculus; identical to SEQ ID NO: 2351

SEQ ID NO: 2732 - protein, 112 aa, Mus musculus; identical to SEQ ID NO: 2352

SEQ ID NO: 2733 - DNA, 357 bp, Mus musculus; identical to SEQ ID NO: 2693

SEQ ID NO: 2734 - protein, 119 aa, Mus musculus; identical to SEQ ID NO: 2694

SEQ ID NO: 2735 - DNA, 336 bp, Mus musculus; identical to SEQ ID NO: 2507

SEQ ID NO: 2736 - protein, 112 aa, Mus musculus; identical to SEQ ID NO: 2300

SEQ ID NO: 2737 - DNA, 363 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaaaggggacctactataggtacgacgcctttgactactggggccaaggcaccactctcacagtctcctca

SEQ ID NO: 2738 - protein, 121 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARKGTYYRYDAFDYWGQGTTLTVSS

SEQ ID NO: 2739 - DNA, 336 bp, Mus musculus; identical to SEQ ID NO: 2351

SEQ ID NO: 2740 - protein, 112 aa, Mus musculus; identical to SEQ ID NO: 2352

SEQ ID NO: 2741 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagagggacattttgactactggggccaaggcaccactctcacagtctcctca

SEQ ID NO: 2742 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGHFDYWGQGTTLTVSS

SEQ ID NO: 2743 - DNA, 336 bp, Mus musculus; identical to SEQ ID NO: 2375

SEQ ID NO: 2744 - protein, 112 aa, Mus musculus; identical to SEQ ID NO: 2376

SEQ ID NO: 2745 - DNA, 336 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtactaccatctactatgcagacacagtgaagggccgattcaccatctccagagacaatcccaagaacaccctattcctacaaatgaccagtctaaggtctgaggacacggccatgtattactgtggcggctttgcttactggggccaagggactctggtcactgtctctgca

SEQ ID NO: 2746 - protein, 112 aa, Mus musculus
DVQLVESGGGLVQPGGSRKLSCAASGFTFSSFGMHWVRQAPEKGLEWVAYISSGSTTIYYADTVKGRFTISRDNPKNTLFLQMTSLRSEDTAMYYCGGFAYWGQGTLVTVSA

SEQ ID NO: 2747 - DNA, 336 bp, Mus musculus; identical to SEQ ID NO: 2363

SEQ ID NO: 2748 - protein, 112 aa, Mus musculus; identical to SEQ ID NO: 2364

SEQ ID NO: 2749 - DNA, 372 bp, Mus musculus
gaagtgaagctggtggagtctgggggaggcttagtgcagcctggagggtccctgaaactctcctgtgcaacctctggattcactttcagtgactattacatgtattgggttcgccagactccagagaagaggctggagtgggtcgcatacattagtaatggtggtggtagcacctattatccagacactgtaaagggccgattcaccatctccagagacaatgccaagaacaccctgtacctgcaaatgagccgtctgaagtctgaggacacagccatgtattactgtgcaagagggacctcatacggtagtggccttcattactatgctatggactactggggtcaaggaacctcagtcaccgtctcctca

SEQ ID NO: 2750 - protein, 124 aa, Mus musculus
EVKLVESGGGLVQPGGSLKLSCATSGFTFSDYYMYWVRQTPEKRLEWVAYISNGGGSTYYPDTVKGRFTISRDNAKNTLYLQMSRLKSEDTAMYYCARGTSYGSGLHYYAMDYWGQGTSVTVSS

SEQ ID NO: 2751 - DNA, 336 bp, Mus musculus
gatgttgtgatggcccaaactccactctccctgcctgtcagtcttggagatcaagcctccatctcttgcagatctagtcagagacttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgctcacgttcggtgctgggaccaagctggagctgaaa

SEQ ID NO: 2752 - protein, 112 aa, Mus musculus
DVVMAQTPLSLPVSLGDQASISCRSSQRLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 2753 - DNA, 357 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatggtaactacgtaggctggtttgcttactggggccaagggactctggtcactgtctctgca

SEQ ID NO: 2754 - protein, 119 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGNYVGWFAYWGQGTLVTVSA

SEQ ID NO: 2755 - DNA, 336 bp, Mus musculus; identical to SEQ ID NO: 2507

SEQ ID NO: 2756 - protein, 112 aa, Mus musculus; identical to SEQ ID NO: 2300

SEQ ID NO: 2757 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagaggaaggtactatgctatggactactggggtcaaggaacctcagtcaccgtctcctca

SEQ ID NO: 2758 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGRYYAMDYWGQGTSVTVSS

SEQ ID NO: 2759 - DNA, 336 bp, Mus musculus; identical to SEQ ID NO: 2303

SEQ ID NO: 2760 - protein, 112 aa, Mus musculus; identical to SEQ ID NO: 2304

SEQ ID NO: 2761 - DNA, 360 bp, Mus musculus
gaagtgaagcttgaggagtctggaggaggcttggtgcaacctggaggatccatgaaactctcctgtgttgcctctggattcactttcagtaactactggatgaactgggtccgccagtctccagagaaggggcttgagtgggttgctgaaattagattgaaatctaataattatgcaacacattatgcggagtctgtgaaagggaggttcaccatctcaagagatgattccaaaagtagtgtctacctgcaaatgaacaacttaagagctgaagacactggcatttattactgtaccagggcgcgacgagggtatgctatggactactggggtcaaggaacctcagtcaccgtctcctca

SEQ ID NO: 2762 - protein, 120 aa, Mus musculus
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRARRGYAMDYWGQGTSVTVSS

SEQ ID NO: 2763 - DNA, 336 bp, Mus musculus
gacattgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatcccacgttcggaggggggaccaagctggaaataaaa

SEQ ID NO: 2764 - protein, 112 aa, Mus musculus
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPTFGGGTKLEIK

SEQ ID NO: 2765 - DNA, 357 bp, Mus musculus
caggtccagcttcagcagtctggggctgaactggcaaaacctggggcctcagtgaagatgtcctgcaaggcttctggctacacctttactagctactggatgcactgggtaaaacagaggcctggacagggtctggaatggattggatacattaatcctagcactggttatactgagtacaatcagaagttcaaggacaaggccacattgactgcagacaaatcctccagcacagcctacatgcaactgagcagcctgacatctgaggactctgcagtctattactgtgattactacggtagtagctacgggtacttcgatgtctggggcgcagggaccacggtcaccgtctcctca

SEQ ID NO: 2766 - protein, 119 aa, Mus musculus
QVQLQQSGAELAKPGASVKMSCKASGYTFTSYWMHWVKQRPGQGLEWIGYINPSTGYTEYNQKFKDKATLTADKSSSTAYMQLSSLTSEDSAVYYCDYYGSSYGYFDVWGAGTTVTVSS

SEQ ID NO: 2767 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttttttctgctctcaaagtacacatgttccgctcacgttcggtgctgggaccaagctggagctgaaa

SEQ ID NO: 2768 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVFFCSQSTHVPLTFGAGTKLELK

SEQ ID NO: 2769 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaagtaactacgtgatttactatgctatggactactggggtcaaggaacctcagtcaccgtctcctca

SEQ ID NO: 2770 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNYVIYYAMDYWGQGTSVTVSS

SEQ ID NO: 2771 - DNA, 336 bp, Mus musculus; identical to SEQ ID NO: 2303

SEQ ID NO: 2772 - protein, 112 aa, Mus musculus; identical to SEQ ID NO: 2304

SEQ ID NO: 2773 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaatagggttcggttactactatgctatggactactggggtcaaggaacctcagtcaccgtctcctca

SEQ ID NO: 2774 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIGFGYYYAMDYWGQGTSVTVSS

SEQ ID NO: 2775 - DNA, 336 bp, Mus musculus; identical to SEQ ID NO: 2439

SEQ ID NO: 2776 - protein, 112 aa, Mus musculus; identical to SEQ ID NO: 2440

SEQ ID NO: 2777 - DNA, 342 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatatgatggttactactggggccaaggcaccactctcacagtctcctca

SEQ ID NO: 2778 - protein, 114 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYDGYYWGQGTTLTVSS

SEQ ID NO: 2779 - DNA, 336 bp, Mus musculus; identical to SEQ ID NO: 2303

SEQ ID NO: 2780 - protein, 112 aa, Mus musculus; identical to SEQ ID NO: 2304

SEQ ID NO: 2781 - DNA, 348 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagagatgaggggtactttgactactggggccaaggcaccactctcacagtctcctca

SEQ ID NO: 2782 - protein, 116 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDEGYFDYWGQGTTLTVSS

SEQ ID NO: 2783 - DNA, 336 bp, Mus musculus; identical to SEQ ID NO: 2507

SEQ ID NO: 2784 - protein, 112 aa, Mus musculus; identical to SEQ ID NO: 2300

SEQ ID NO: 2785 - DNA, 363 bp, Mus musculus; identical to SEQ ID NO: 2737

SEQ ID NO: 2786 - protein, 121 aa, Mus musculus; identical to SEQ ID NO: 2738

SEQ ID NO: 2787 - DNA, 336 bp, Mus musculus; identical to SEQ ID NO: 2351

SEQ ID NO: 2788 - protein, 112 aa, Mus musculus; identical to SEQ ID NO: 2352

SEQ ID NO: 2789 - DNA, 354 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgcttcctatggtaagatcccctttgactactggggccaaggcaccactctcacagtctcctca

SEQ ID NO: 2790 - protein, 118 aa, Mus musculus
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCASYGKIPFDYWGQGTTLTVSS

SEQ ID NO: 2791 - DNA, 336 bp, Mus musculus; identical to SEQ ID NO: 2507

SEQ ID NO: 2792 - protein, 112 aa, Mus musculus; identical to SEQ ID NO: 2300

SEQ ID NO: 2793 - DNA, 360 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagaactacgccttccctggtttgcttactggggccaagggactctggtcactgtctctgca

SEQ ID NO: 2794 - protein, 120 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRELRLPWFAYWGQGTLVTVSA

SEQ ID NO: 2795 - DNA, 336 bp, Mus musculus; identical to SEQ ID NO: 2303

SEQ ID NO: 2796 - protein, 112 aa, Mus musculus; identical to SEQ ID NO: 2304

SEQ ID NO: 2797 - DNA, 354 bp, Mus musculus
gatgtgcagctggtggagtctgggggaggcttagtgcagcctggagggtcccggaatctctcctgtgcagcctctggattcactttcagtagctttggaatgcactgggttcgtcaggctccagtgaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagcgactacggtagtagctcgtttgcttactggggccaagggactctggtcactgtctctgca

SEQ ID NO: 2798 - protein, 118 aa, Mus musculus
DVQLVESGGGLVQPGGSRNLSCAASGFTFSSFGMHWVRQAPVKGLEWVAYISSGSSTIYYADTVKGRFTISRDNPKNTLFLQMTSLRSEDTAMYYCASDYGSSSFAYWGQGTLVTVSA

SEQ ID NO: 2799 - DNA, 336 bp, Mus musculus; identical to SEQ ID NO: 2507

SEQ ID NO: 2800 - protein, 112 aa, Mus musculus; identical to SEQ ID NO: 2300

SEQ ID NO: 2801 - DNA, 360 bp, Mus musculus
caggtccaactgcagcagcctggggctgaactggtgaagcctggggcttcagtgaagttgtcctgcaaggcttctggctacaccttcaccagctactatatgtactgggtgaagcagaggcctggacaaggccttgagtggattggggggattaatcctagcaatggtggtactaacttcaatgagaagttcaagagcaaggccacactgactgtagacaaatcctccagcacagcctacatgcaactcagcagcctgacatctgaggactctgcggtctattactgtacaagagagaggaaaattcattactacggctacgactactggggccaaggcaccactctcacagtctcctca

SEQ ID NO: 2802 - protein, 120 aa, Mus musculus
QVQLQQPGAELVKPGASVKLSCKASGYTFTSYYMYWVKQRPGQGLEWIGGINPSNGGTNFNEKFKSKATLTVDKSSSTAYMQLSSLTSEDSAVYYCTRERKIHYYGYDYWGQGTTLTVSS

SEQ ID NO: 2803 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtacacgttcggaggggggaccaagctggaaataaaa

SEQ ID NO: 2804 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 2805 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaatttactacggtagtagcggagcgtttgcttactggggccaagggactctggtcactgtctctgca

SEQ ID NO: 2806 - protein, 120 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIYYGSSGAFAYWGQGTLVTVSA

SEQ ID NO: 2807 - DNA, 336 bp, Mus musculus
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggaggggggaccaagctggaaataaaa

SEQ ID NO: 2808 - protein, 112 aa, Mus musculus; identical to SEQ ID NO: 2352

SEQ ID NO: 2809 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaggggggacgggggctatggactactggggtcaaggaacctcagtcaccgtctcctca

SEQ ID NO: 2810 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGTGAMDYWGQGTSVTVSS

SEQ ID NO: 2811 - DNA, 336 bp, Mus musculus; identical to SEQ ID NO: 2351

SEQ ID NO: 2812 - protein, 112 aa, Mus musculus; identical to SEQ ID NO: 2352

SEQ ID NO: 2813 - DNA, 357 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagagctcggaggtacgctatggactactggggtcaaggaacctcagtcaccgtctcctca

SEQ ID NO: 2814 - protein, 119 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRARRYAMDYWGQGTSVTVSS

SEQ ID NO: 2815 - DNA, 336 bp, Mus musculus; identical to SEQ ID NO: 2303

SEQ ID NO: 2816 - protein, 112 aa, Mus musculus; identical to SEQ ID NO: 2304

SEQ ID NO: 2817 - DNA, 351 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagaaaccaggtattcctcaagatcaccagtgtggacactgcagatactgccacatactactgtgctcgaagagctggggggtttgcttactggggccaagggactctggtcactgtctctgca

SEQ ID NO: 2818 - protein, 117 aa, Mus musculus; identical to SEQ ID NO: 2510

SEQ ID NO: 2819 - DNA, 324 bp, Mus musculus
gacatcctgctgacccagtctccagccaccctgtctgtgactccaggagaaacagtcagtctttcctgtagggccagccagagtatttacaagaacctacactggtatcaacagaaatcacatcggtctccaaggcttctcatcaagtatgcttctgattccatctctgggatcccctccaggttcactggcagtggatcagggacagattacactctcagtatcaacagtgtgaagcccgaagatgaaggaatatattactgtcttcaaggttacagcacacccatgtacacgttcggaggggggaccaagctggaaataaaa

SEQ ID NO: 2820 - protein, 108 aa, Mus musculus
DILLTQSPATLSVTPGETVSLSCRASQSIYKNLHWYQQKSHRSPRLLIKYASDSISGIPSRFTGSGSGTDYTLSINSVKPEDEGIYYCLQGYSTPMYTFGGGTKLEIK

SEQ ID NO: 2821 - DNA, 348 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaggtagtaactttgactactggggccaaggcaccactctcacagtctcctca

SEQ ID NO: 2822 - protein, 116 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARGSNFDYWGQGTTLTVSS

SEQ ID NO: 2823 - DNA, 336 bp, Mus musculus; identical to SEQ ID NO: 2507

SEQ ID NO: 2824 - protein, 112 aa, Mus musculus; identical to SEQ ID NO: 2300

SEQ ID NO: 2825 - DNA, 369 bp, Mus musculus
caggttactctgaaagagtctggccctgggatattgcagccctcccagaccctcagtctgacttgttctttctctgggttttcactgagcacttctggtatgggtgtgagctggattcgtcagccttcaggaaagggtctggagtggctggcacacatttactgggatgatgacaagcgctataacccatccctgaagagccggctcacaatctccaaggatacctccagcaaccaggtattcctcaagatcaccagtgtggacactgcagatactgccacatactactgtgctcgaagaggggtctactataggtacgacgatgctatggactactggggtcaaggaacctcagtcaccgtctcctca

SEQ ID NO: 2826 - protein, 123 aa, Mus musculus
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRGVYYRYDDAMDYWGQGTSVTVSS

SEQ ID NO: 2827 - DNA, 336 bp, Mus musculus; identical to SEQ ID NO: 2303

SEQ ID NO: 2828 - protein, 112 aa, Mus musculus; identical to SEQ ID NO: 2304

SEQ ID NO: 2829 - DNA, 354 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaggagggcacgtgggtgctatggactactggggtcaaggaacctcagtcaccgtctcctca

SEQ ID NO: 2830 - protein, 118 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGHVGAMDYWGQGTSVTVSS

SEQ ID NO: 2831 - DNA, 336 bp, Mus musculus; identical to SEQ ID NO: 2439

SEQ ID NO: 2832 - protein, 112 aa, Mus musculus; identical to SEQ ID NO: 2440

SEQ ID NO: 2833 - DNA, 366 bp, Mus musculus
caagttactctaaaagagtctggccctgggatattgaagcccccacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagcgcaacaactgggacgaagggaactatggactactggggtcaaggaacctcagtcaccgtctcctca

SEQ ID NO: 2834 - protein, 122 aa, Mus musculus
QVTLKESGPGILKPPQTLSLTCSFSGFSLSTSGMGVGWIRQPSGKGLEWLAHIWWDDDKYYNPSLKSQLTISKDTSRNQVFLKITSVDTADTATYYCARSATTGTKGTMDYWGQGTSVTVSS

SEQ ID NO: 2835 - DNA, 336 bp, Mus musculus; identical to SEQ ID NO: 2303

SEQ ID NO: 2836 - protein, 112 aa, Mus musculus; identical to SEQ ID NO: 2304

SEQ ID NO: 2837 - DNA, 360 bp, Mus musculus
gatgtgcagctggtggagtctgggggaggcttagtgcagcctggagggtcccggaaactctcctgtgcagcctctggattcagtttcagtagctttggaatgcactgggttcgtcaggctccagagaaggggctggagtgggtcgcatacattagtagtggcaggagtaccatctactatgcagacacagtgaagggccgattcaccatctccagagacaatcccaagaacaccctgttcctgcaaatgaccagtctaaggtctgaggacacggccatgtattactgtgcaagattgaggggtaacttggactatgctatggactactggggtcaaggaacctcagtcaccgtctcctca

SEQ ID NO: 2838 - protein, 120 aa, Mus musculus
DVQLVESGGGLVQPGGSRKLSCAASGFSFSSFGMHWVRQAPEKGLEWVAYISSGRSTIYYADTVKGRFTISRDNPKNTLFLQMTSLRSEDTAMYYCARLRGNLDYAMDYWGQGTSVTVSS

SEQ ID NO: 2839 - DNA, 336 bp, Mus musculus; identical to SEQ ID NO: 2623

SEQ ID NO: 2840 - protein, 112 aa, Mus musculus; identical to SEQ ID NO: 2624

SEQ ID NO: 2841 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagattagatggttacaggggtgactactggggccaaggcaccactctcacagtctcctca

SEQ ID NO: 2842 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLDGYRGDYWGQGTTLTVSS

SEQ ID NO: 2843 - DNA, 336 bp, Mus musculus
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggctcggggacaaagttggaaataaaa

SEQ ID NO: 2844 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGSGTKLEIK

SEQ ID NO: 2845 - DNA, 372 bp, Mus musculus
gaagtgaagctggtggagtctgggggaggcttagtgcagcctggagggtccctgaaactctcctgtgcaacctctggattcactttcagtgactattacatgtattgggttcgccagactccagagaagaggctggagtgggtcgcatacattagtaatggtggtggtagaacctattatccagacactgtaaagggccgattcaccatctccagagacaatgccaagaacaccctgtacctgcaaatgagccgtctgaagtctgaggacacagccatgtattactgtgccagagggacctcatacggtagtggccttcattactatgctatggactactggggtcaaggaacctcagtcaccgtctcctca

SEQ ID NO: 2846 - protein, 124 aa, Mus musculus
EVKLVESGGGLVQPGGSLKLSCATSGFTFSDYYMYWVRQTPEKRLEWVAYISNGGGRTYYPDTVKGRFTISRDNAKNTLYLQMSRLKSEDTAMYYCARGTSYGSGLHYYAMDYWGQGTSVTVSS

SEQ ID NO: 2847 - DNA, 336 bp, Mus musculus; identical to SEQ ID NO: 2507

SEQ ID NO: 2848 - protein, 112 aa, Mus musculus; identical to SEQ ID NO: 2300

SEQ ID NO: 2849 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagatactattactatgctatggactactggggtcaaggaacctcagtcaccgtctcctca

SEQ ID NO: 2850 - protein, 117 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYYYAMDYWGQGTSVTVSS

SEQ ID NO: 2851 - DNA, 336 bp, Mus musculus; identical to SEQ ID NO: 2351

SEQ ID NO: 2852 - protein, 112 aa, Mus musculus; identical to SEQ ID NO: 2352

SEQ ID NO: 2853 - DNA, 360 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtggtggcagtagtaccatctactatgcagacacagtgaagggccgattcaccatctccagagacaatcccaagaacaccctgttcctgcaaatgaccagtctaaggtctaaggacacggccatgtattactgtgcaagatccccatttctacggctacagggacttgcttactggggccaagggactctggtcactgtctctgca

SEQ ID NO: 2854 - protein, 120 aa, Mus musculus
DVQLVESGGGLVQPGGSRKLSCAASGFTFSSFGMHWVRQAPEKGLEWVAYISGGSSTIYYADTVKGRFTISRDNPKNTLFLQMTSLRSKDTAMYYCARSPFLRLQGLAYWGQGTLVTVSA

SEQ ID NO: 2855 - DNA, 336 bp, Mus musculus; identical to SEQ ID NO: 2351

SEQ ID NO: 2856 - protein, 112 aa, Mus musculus; identical to SEQ ID NO: 2352

SEQ ID NO: 2857 - DNA, 363 bp, Mus musculus
caagttactctaaaagagtctggccctgggatattgaagccctcacagaccctcagtctgacttgttctttctctgggttttcactgagcacttctggtatgggtgtaggctggattcgtcagccttcagggaagggtctggagtggctggcacacatttggtgggatgatgataagtactataacccatccctgaagagccagctcacaatctccaaggatacctccagaaaccaggtattcctcaagatcaccagtgtggacactgcagatactgccacttactactgtgctcgaagagcttcgagggggactgatgctatggactactggggtcaaggaacctcagtcaccgtctcctca

SEQ ID NO: 2858 - protein, 121 aa, Mus musculus; identical to SEQ ID NO: 2434

SEQ ID NO: 2859 - DNA, 336 bp, Mus musculus; identical to SEQ ID NO: 2339

SEQ ID NO: 2860 - protein, 112 aa, Mus musculus; identical to SEQ ID NO: 2304

SEQ ID NO: 2861 - DNA, 345 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacagtgaagggccgattcaccatctccagagacaatcccaagaacaccctgttcctgcaaatgaccagtctaaggtctgaggacacggccatgtattactgtgcaagaggtaactaccctgactactggggccaaggcaccactctcacagtctcctca

SEQ ID NO: 2862 - protein, 115 aa, Mus musculus
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGNYPDYWGQGTTLTVSS

SEQ ID NO: 2863 - DNA, 336 bp, Mus musculus; identical to SEQ ID NO: 2375

SEQ ID NO: 2864 - protein, 112 aa, Mus musculus; identical to SEQ ID NO: 2376

SEQ ID NO: 2865 - DNA, 15 bp, Mus musculus
agctttggaatgcac

SEQ ID NO: 2866 - protein, 5 aa, Mus musculus
SFGMH

SEQ ID NO: 2867 - DNA, 51 bp, Mus musculus; identical to SEQ ID NO: 119

SEQ ID NO: 2868 - protein, 17 aa, Mus musculus
YISSGSSTIYYADTVKG

SEQ ID NO: 2869 - DNA, 18 bp, Mus musculus
ggtaactaccctgactac

SEQ ID NO: 2870 - protein, 6 aa, Mus musculus
GNYPDY

SEQ ID NO: 2871 - DNA, 48 bp, Mus musculus; identical to SEQ ID NO: 43

SEQ ID NO: 2872 - protein, 16 aa, Mus musculus
RSSQSLVHSNGNTYLH

SEQ ID NO: 2873 - DNA, 21 bp, Mus musculus
aaagtttccaaccgattttct

SEQ ID NO: 2874 - protein, 7 aa, Mus musculus
KVSNRFS

SEQ ID NO: 2875 - DNA, 27 bp, Mus musculus
tctcaaagtacacatgttcctccgacg

SEQ ID NO: 2876 - protein, 9 aa, Mus musculus
SQSTHVPPT

SEQ ID NO: 2877 - DNA, 351 bp, Mus musculus
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccatctactatgcagacacattgaagggccgattcaccatctccagagacaatcccaagaacaccctgttcctgcaaatgaccagtctaaggtctgaggacacggccatgtattactgtgcaagatatggtaactatgctatggactactggggtcaaggaacctcagtcaccgtctcctca

SEQ ID NO: 2878 - protein, 117 aa, Mus musculus
DVQLVESGGGLVQPGGSRKLSCAASGFTFSSFGMHWVRQAPEKGLEWVAYISSGSSTIYYADTLKGRFTISRDNPKNTLFLQMTSLRSEDTAMYYCARYGNYAMDYWGQGTSVTVSS

SEQ ID NO: 2879 - DNA, 333 bp, Mus musculus
gacattgtgctgacccaatctccagcttctttggctgtgtctctagggcagagggccaccatctcctgcaaggccagccaaagtgttgattatgatggtgatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatcctcggacgttcggtggaggcaccaagctggaaatcaaa

SEQ ID NO: 2880 - protein, 111 aa, Mus musculus
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIK

SEQ ID NO: 2881 - DNA, 15 bp, Mus musculus
agctttggaatgcac

SEQ ID NO: 2882 - protein, 5 aa, Mus musculus
SFGMH

SEQ ID NO: 2883 - DNA, 51 bp, Mus musculus
tacattagtagtggcagtagtaccatctactatgcagacacattgaagggc

SEQ ID NO: 2884 - protein, 17 aa, Mus musculus
YISSGSSTIYYADTLKG

SEQ ID NO: 2885 - DNA, 24 bp, Mus musculus
tatggtaactatgctatggactac

SEQ ID NO: 2886 - protein, 8 aa, Mus musculus
YGNYAMDY

SEQ ID NO: 2887 - DNA, 45 bp, Mus musculus
aaggccagccaaagtgttgattatgatggtgatagttatatgaac

SEQ ID NO: 2888 - protein, 15 aa, Mus musculus
KASQSVDYDGDSYMN

SEQ ID NO: 2889 - DNA, 21 bp, Mus musculus
gctgcatccaatctagaatct

SEQ ID NO: 2890 - protein, 7 aa, Mus musculus
AASNLES

SEQ ID NO: 2891 - DNA, 27 bp, Mus musculus
cagcaaagtaatgaggatcctcggacg

SEQ ID NO: 2892 - protein, 9 aa, Mus musculus
QQSNEDPRT

SEQ ID NO: 2893 - DNA, 57 bp, Mus musculus
atgaacttcgggctcagcttgattttccttgccctcattttaaaaggtgtccagtgt

SEQ ID NO: 2894 - protein, 19 aa, Mus musculus
MNFGLSLIFLALILKGVQC

SEQ ID NO: 2895 - DNA, 57 bp, Mus musculus
atgaacaggcttacttcctcattgctgctgctgattgtccctgcatatgtcctgtcc

SEQ ID NO: 2896 - DNA, 57 bp, Mus musculus
atgaacaggctcacttcctcattgctgctgctgattgtccctgcatatgtcctgtcc

SEQ ID NO: 2897 - protein, 19 aa, Mus musculus
MNRLTSSLLLLIVPAYVLS

SEQ ID NO: 2898 - DNA, 57 bp, Mus musculus
atggacaggcttacttcctcattcctgctgctgattgtccctgcatatgtcctttcc

SEQ ID NO: 2899 - DNA, 57 bp, Mus musculus
atggacaggcttacttcttcattcctgctgctgattgtccctgcatatgtcttgtcc

SEQ ID NO: 2900 - protein, 19 aa, Mus musculus
MDRLTSSFLLLIVPAYVLS

SEQ ID NO: 2901 - DNA, 57 bp, Mus musculus
atggactccaggctcaatttagttttccttgtccttattttaaaaggtgtccagtgt

SEQ ID NO: 2902 - protein, 19 aa, Mus musculus
MDSRLNLVFLVLILKGVQC

SEQ ID NO: 2903 - DNA, 57 bp, Mus musculus
atggacaggcttacttcttcattcctgctgctgattgtccctgcatatatcttgtcc

SEQ ID NO: 2904 - protein, 19 aa, Mus musculus
MDRLTSSFLLLIVPAYILS

SEQ ID NO: 2905 - DNA, 57 bp, Mus musculus
atgaactttgtgctcagcttgattttccttgccctcattttaaaaggtgtccagtgt

SEQ ID NO: 2906 - protein, 19 aa, Mus musculus
MNFVLSLIFLALILKGVQC

SEQ ID NO: 2907 - DNA, 57 bp, Mus musculus
atgggcaggcttacttcttcattcctgctactgattgtccctgcatatgtcctgtcc

SEQ ID NO: 2908 - DNA, 57 bp, Mus musculus
atgggcaggcttacttcttcattcttgctactgattgtccctgcatatgtcctgtcc

SEQ ID NO: 2909 - protein, 19 aa, Mus musculus
MGRLTSSFLLLIVPAYVLS

SEQ ID NO: 2910 - DNA, 57 bp, Mus musculus
atggaatggacctgggtctttctcttcctcctgtcagtaactgcaggtgtccactcc

SEQ ID NO: 2911 - protein, 19 aa, Mus musculus
MEWTWVFLFLLSVTAGVHS

SEQ ID NO: 2912 - DNA, 57 bp, Mus musculus
atgaacaggcttgcttcctcattgctgctgctgattgtccctgcatatgtcctgtcc

SEQ ID NO: 2913 - protein, 19 aa, Mus musculus
MNRLASSLLLLIVPAYVLS

SEQ ID NO: 2914 - DNA, 54 bp, Mus musculus
atgagagtgctgattcttttgtgcctgttcacagcctttcctggtatcctgtct

SEQ ID NO: 2915 - protein, 18 aa, Mus musculus
MRVLILLCLFTAFPGILS

SEQ ID NO: 2916 - DNA, 57 bp, Mus musculus
atggacaggcttacttcttcattcctgctgctgattgcccctgcatatgtcttgtcc

SEQ ID NO: 2917 - protein, 19 aa, Mus musculus
MDRLTSSFLLLIAPAYVLS

SEQ ID NO: 2918 - DNA, 57 bp, Mus musculus
atggctgtcttggggctgctcttctgcctggtgacattcccaagctgtgtcctatcc

SEQ ID NO: 2919 - protein, 19 aa, Mus musculus
MAVLGLLFCLVTFPSCVLS

SEQ ID NO: 2920 - DNA, 57 bp, Mus musculus
atggaaaggcactggatctttctcttcctgttttcagtaactgcaggtgtccactcc

SEQ ID NO: 2921 - protein, 19 aa, Mus musculus
MERHWIFLFLFSVTAGVHS

SEQ ID NO: 2922 - DNA, 57 bp, Mus musculus
atgaaatgcagctgggttatcttcttcctgatggcagtggttacaggggtcaattca

SEQ ID NO: 2923 - protein, 19 aa, Mus musculus
MKCSWVIFFLMAVVTGVNS

SEQ ID NO: 2924 - DNA, 57 bp, Mus musculus
atgtacttgggactgaactgtgtattcatagtttttctcttaaaaggtgtccagagt

SEQ ID NO: 2925 - protein, 19 aa, Mus musculus
MYLGLNCVFIVFLLKGVQS

SEQ ID NO: 2926 - DNA, 57 bp, Mus musculus
atgggatggagctatatcatcctctttttggtagcaacagctacagatgtccactcc

SEQ ID NO: 2927 - protein, 19 aa, Mus musculus
MGWSYIILFLVATATDVHS

SEQ ID NO: 2928 - DNA, 57 bp, Mus musculus
atggctgtcctggggctgcttctctgcctggtgactttcccaagctgtgtcctgtcc

SEQ ID NO: 2929 - protein, 19 aa, Mus musculus
MAVLGLLLCLVTFPSCVLS

SEQ ID NO: 2930 - DNA, 57 bp, Mus musculus
atgaacttggggctcagcttgattttccttgtccttgttttaaaaggtgtccagtgt

SEQ ID NO: 2931 - protein, 19 aa, Mus musculus
MNLGLSLIFLVLVLKGVQC

SEQ ID NO: 2932 - DNA, 57 bp, Mus musculus
atggacaggcttacttcctcattgctgctgctgattgtccctgcatatgtcctgtcc

SEQ ID NO: 2933 - protein, 19 aa, Mus musculus
MDRLTSSLLLLIVPAYVLS

SEQ ID NO: 2934 - DNA, 57 bp, Mus musculus
atgggatggagctatatcatcctctttttggtagcaacagctacaggtgtccactcc

SEQ ID NO: 2935 - protein, 19 aa, Mus musculus
MGWSYIILFLVATATGVHS

SEQ ID NO: 2936 - DNA, 57 bp, Mus musculus
atggacaggcttacttcttcattcctgctgctgattgtccctgcatatgtcttgccc

SEQ ID NO: 2937 - protein, 19 aa, Mus musculus
MDRLTSSFLLLIVPAYVLP

SEQ ID NO: 2938 - DNA, 60 bp, Mus musculus
atggattcacaggcccaggttcttatattgctgctgctatgggtatctggtacctgtggg

SEQ ID NO: 2939 - protein, 20 aa, Mus musculus
MDSQAQVLILLLLWVSGTCG

SEQ ID NO: 2940 - DNA, 57 bp, Mus musculus
atgaagttgcctgttaggctgttggtgctgatgttctggattcctgcttccagcagt

SEQ ID NO: 2941 - DNA, 57 bp, Mus musculus
atgaagttgcctgttaggctgttggtgctgatgttctggattcctgcttccagtagt

SEQ ID NO: 2942 - DNA, 57 bp, Mus musculus
atgaagttgcctgttaggctgttggtgctgatgttctggattcctgcttccagcagc

SEQ ID NO: 2943 - protein, 19 aa, Mus musculus
MKLPVRLLVLMFWIPASSS

SEQ ID NO: 2944 - DNA, 57 bp, Mus musculus
atgaagttgcctgttaggctgttggtgctgatgttctggattcctgcttccaacagt

SEQ ID NO: 2945 - protein, 19 aa, Mus musculus
MKLPVRLLVLMFWIPASNS

SEQ ID NO: 2946 - DNA, 57 bp, Mus musculus
atgaagttgcctgttaggctgttggtgctgacgttctggattcctgcttccagcagt

SEQ ID NO: 2947 - protein, 19 aa, Mus musculus
MKLPVRLLVLTFWIPASSS

SEQ ID NO: 2948 - DNA, 60 bp, Mus musculus
atgatgagtcctgtccagttcctgtttctgttagtgctctggattcaggaaaccaacggt

SEQ ID NO: 2949 - protein, 20 aa, Mus musculus
MMSPVQFLFLLVLWIQETNG

SEQ ID NO: 2950 - DNA, 60 bp, Mus musculus
atggaatcacagactcaggtcctcatgtccctgctgttctgggtatctggtacctgtggg

SEQ ID NO: 2951 - protein, 20 aa, Mus musculus
MESQTQVLMSLLFWVSGTCG

SEQ ID NO: 2952 - DNA, 57 bp, Mus musculus
atgaagttgcctgttaagctgttggtgctgatgttctggattcctgcttccagcagt

SEQ ID NO: 2953 - protein, 19 aa, Mus musculus
MKLPVKLLVLMFWIPASSS

SEQ ID NO: 2954 - DNA, 60 bp, Mus musculus
atggattcacaggcccaggttcttatgttactgctgctatgggtatctggtacctgtggg

SEQ ID NO: 2955 - protein, 20 aa, Mus musculus
MDSQAQVLMLLLLWVSGTCG

SEQ ID NO: 2956 - DNA, 57 bp, Mus musculus
atgaagttgcctgttgggctgttggtgctgatgttctggattcctgcttccagcagt

SEQ ID NO: 2957 - protein, 19 aa, Mus musculus
MKLPVGLLVLMFWIPASSS

SEQ ID NO: 2958 - DNA, 57 bp, Mus musculus
atgaagttgcctgtttggctgttggtgctgatgttctggattcctgcttccagcagt

SEQ ID NO: 2959 - protein, 19 aa, Mus musculus
MKLPVWLLVLMFWIPASSS

SEQ ID NO: 2960 - DNA, 60 bp, Mus musculus
atggtattcacacctcatatccttggacttctgcttttctggatttcagcctccacaggt

SEQ ID NO: 2961 - protein, 20 aa, Mus musculus
MVFTPHILGLLLFWISASTG

SEQ ID NO: 2962 - DNA, 60 bp, Mus musculus
atggagacagacacaatcctgctatgggtgctgctgctctgggttccaggctccactggt

SEQ ID NO: 2963 - protein, 20 aa, Mus musculus
METDTILLWVLLLWVPGSTG

SEQ ID NO: 2964 - DNA, 22 bp, Artificial
  a primer sequence
aaggcttacaaccacaatccct

SEQ ID NO: 2965 - DNA, 19 bp, Artificial
  a primer sequence
tgctgggcatttgcatgga

SEQ ID NO: 2966 - DNA, 19 bp, Artificial
  a primer sequence
tgggcatttgtgacactcc

SEQ ID NO: 2967 - DNA, 21 bp, Artificial
  a primer sequence
actgggcttgggtattctagg

SEQ ID NO: 2968 - DNA, 31 bp, Artificial
  a primer sequence
gtccaactgttcaggacgccattttgtcgtt

SEQ ID NO: 2969 - DNA, 27 bp, Artificial
  a primer sequence
tccacagtgtgaccttcatgagtgacc

SEQ ID NO: 2970 - DNA, 19 bp, Artificial
  a primer sequence
acagggatccagagttcca

SEQ ID NO: 2971 - DNA, 18 bp, Artificial
  a primer sequence
taactgctcactggatgg

SEQ ID NO: 2972 - DNA, 24 bp, Artificial
  a primer sequence
agtgtggccttgttagtctcgagc

SEQ ID NO: 2973 - DNA, 30 bp, Artificial
  a primer sequence
ggccacgcgtcgactagtacgggggggggg

SEQ ID NO: 2974 - DNA, 20 bp, Artificial
  a primer sequence
ggccacgcgtcgactagtac

SEQ ID NO: 2975 - DNA, 24 bp, Artificial
  a primer sequence
cgccagggttttcccagtcacgac

SEQ ID NO: 2976 - DNA, 22 bp, Artificial
  a primer sequence
tcacacaggaaacagctatgac

The invention claimed is:

1. An isolated antibody that specifically binds an isolated A beta (Aβ) oligomer as an antigen, wherein the antibody does not bind to an Aβ monomer, and wherein the antibody comprises a heavy chain having CDR1, CDR2, and CDR3, which are identified in heavy chain variable region comprising the amino acid sequence of SEQ ID NO: 2630, and a light chain having CDR1, CDR2, and CDR3, which are identified in light chain variable region comprising the amino acid sequence of SEQ ID NO: 2632.

2. The antibody of claim 1, which comprises:
   (1) a heavy chain having the amino acid sequence of SEQ ID NO: 1366 as CDR1, the amino acid sequence of SEQ ID NO: 1368 as CDR2, and the amino acid sequence of SEQ ID NO: 1370 as CDR3; or
   (2) a light chain having the amino acid sequence of SEQ ID NO: 1372 as CDR1, the amino acid sequence of SEQ ID NO: 1374 as CDR2, and the amino acid sequence of SEQ ID NO: 1376 as CDR3.

3. The antibody of claim 1, wherein the antibody is a chimeric antibody or a humanized antibody.

4. An antigen-binding fragment of the antibody of claim 1.

5. A pharmaceutical composition comprising the antibody of claim 1, and a pharmaceutically acceptable carrier.

6. The composition of claim 5, which is formulated for administration as a therapeutic agent for treating Alzheimer's disease, an agent for treating cognitive impairment associated with Aβ oligomers, an agent for suppressing senile plaque formation, an agent for suppressing Aβ accumulation, an agent for inhibiting Aβ amyloid fibril formation, or an agent for reducing Aβ-mediated synaptic toxicity.

7. A kit for detecting an Aβ oligomer contained in a sample or for diagnosing whether or not a subject is a possible Alzheimer's disease patient, the kit comprising the antibody of claim 1.

8. A method for detecting an Aβ oligomer, which comprises:
   (a) contacting a sample collected from a subject with the antibody of claim 1; and
   (b) immunologically detecting the presence of an Aβ oligomer in the sample.

9. The method of claim 8, wherein the sample is blood or cerebrospinal fluid.

10. A method of diagnosing whether or not a subject is a possible Alzheimer's disease patient, which comprises:
    (a) contacting a sample collected from a subject with the antibody of claim 1; and
    (b) measuring the amount of Aβ oligomer in the sample, wherein the subject is determined to be a possible Alzheimer's disease patient, when the amount measured in (b) is higher than that of a healthy individual.

11. The method of claim 10, wherein the sample is blood or cerebrospinal fluid.

12. A method of diagnosing whether or not a subject is a possible Alzheimer's disease patient, which comprises:
    (a) contacting a sample collected from a subject with the antibody of claim 1, and an antibody that binds to an Aβ monomer; and
    (b) measuring the ratio of Aβ oligomer to Aβ monomer in the sample, wherein the subject is determined to be a possible Alzheimer's disease patient, when the ratio measured in (b) is higher than that of a healthy individual.

13. The method of claim 12, wherein the sample is blood or cerebrospinal fluid.

* * * * *